US012594312B2

(12) United States Patent
Lemire et al.

(10) Patent No.: US 12,594,312 B2
(45) Date of Patent: Apr. 7, 2026

(54) **BACTERIOPHAGE COMPOSITIONS FOR TREATING *PSEUDOMONAS* INFECTION**

(71) Applicant: Armata Pharmaceuticals, Inc., Los Angeles, CA (US)

(72) Inventors: Sebastien Lemire, Culver City, CA (US); Stacey Lynn Kolar, Los Angeles, CA (US); Brian C. Varnum, Santa Monica, CA (US); Sandra P. Morales, Sydney (AU)

(73) Assignee: Armata Pharmaceuticals, Inc., Los Angeles, CA (US)

( * ) Notice: Subject to any disclaimer, the term of this patent is extended or adjusted under 35 U.S.C. 154(b) by 617 days.

(21) Appl. No.: 17/241,957

(22) Filed: Apr. 27, 2021

(65) Prior Publication Data

US 2021/0330722 A1     Oct. 28, 2021

Related U.S. Application Data

(60) Provisional application No. 63/016,132, filed on Apr. 27, 2020.

(51) Int. Cl.
| | |
|---|---|
| *A61K 35/76* | (2015.01) |
| *A61K 45/06* | (2006.01) |
| *A61P 31/04* | (2006.01) |
| *C12N 7/00* | (2006.01) |

(52) U.S. Cl.
CPC ............. *A61K 35/76* (2013.01); *A61K 45/06* (2013.01); *A61P 31/04* (2018.01); *C12N 7/00* (2013.01); *C12N 2795/10121* (2013.01); *C12N 2795/10132* (2013.01); *C12N 2795/10171* (2013.01); *C12N 2795/10221* (2013.01); *C12N 2795/10232* (2013.01); *C12N 2795/10271* (2013.01)

(58) Field of Classification Search
None
See application file for complete search history.

(56) References Cited

U.S. PATENT DOCUMENTS

| | | | | |
|---|---|---|---|---|
| 2023/0174954 A1* | 6/2023 | Lemire | .................. | A61K 35/76 424/93.2 |
| 2024/0226205 A1 | 7/2024 | Lemire et al. | | |

FOREIGN PATENT DOCUMENTS

| | | |
|---|---|---|
| CN | 104519893 A | 4/2015 |
| CN | 110612349 A | 12/2019 |
| CN | 110691603 A | 1/2020 |
| EP | 2865383 A1 | 4/2015 |
| EP | 3018201 A1 | 5/2016 |
| JP | 2016537405 A | 12/2016 |
| JP | 2017534684 A | 11/2017 |
| WO | 2019136108 A1 | 7/2019 |
| WO | 2021222257 A1 | 11/2021 |

OTHER PUBLICATIONS

Essoh C, Latino L, et al Investigation of a Large Collection of Pseudomonas aeruginosa Bacteriophages Collected from a Single Environmental Source in Abidjan, Côte d'Ivoire. PLoS One. Jun. 26, 2015;10(6):e01305 (Year: 2015).*
Kutateladze M, Adamia R. Phage therapy experience at the Eliava Institute. Med Mal Infect. Aug. 2008;38(8):426-30. doi: 10.1016/j. medmal.2008.06.023. Epub Aug. 6, 2008. PMID: 18687542. (Year: 2008).*
Forti F, Roach DR, et al. Design of a Broad-Range Bacteriophage Cocktail That Reduces Pseudomonas aeruginosa Biofilms and Treats Acute Infections in Two Animal Models. Antimicrob Agents Chemother. May 25, 2018;62(6):e02573-17. (Year: 2018).*
Pseudomonas phage vB_PaeP_PAO1_1-15pyo, complete genome NCBI Reference Sequence: NC_047967.1 (Year: 2015).*
Pseudomonas phage vB_PaeM_E215, complete genome NCBI Reference Sequence: NC_042080.1 (Year: 2019).*
Pseudomonas phage PAK_P1, complete genome NCBI Reference Sequence: NC_015294.2 (Year: 2010).*
Pseudomonas phage PAK_P4, complete genome NCBI Reference Sequence: NC_022986.1 (Year: 2013).*
Can K, Aksu U, Yenen OŞ. Investigation of PhiKZ phage therapy against Pseudomonas aeruginosa in mouse pneumonia model. Turk J Med Sci. Jun. 14, 2018;48(3):670-678. (Year: 2018).*
Genbank: MK837012.1 (2019) Pseudomonas virus Pa223 (Year: 2019).*
Genbank: MN615701.1 (2019) Pseudomonas phage vB PaeM SMS21 (Year: 2019).*
Genbank: NC_047953.1 (2018) Pseudomonas phage vB PaeP 130_113 (Year: 2018).*
Genbank: MK340761 (2019) Pseudomonas phage vB PaeM SCUT-S2 (Year: 2019).*
Thompson et al. (Nov. 11, 1994) "Clustal W: Improving the Sensitivity of Progressive Multiple Sequence Alignment through Sequence Weighting, Position-Specific Gap Penalties and Weight Matrix Choice", Nucleic Acids Research, 22:4673-4680.
Walle et al. (Jun. 12, 2004) "Align-M-A New Algorithm for Multiple Alignment of Highly Divergent Sequences, Bioinformatics", 20(9):1428-1435.
Invitation to Pay Additional fees received for PCT Patent International Application No. PCT/US2021/029412, mailed on Aug. 4, 2021, 6 pages.
Ceyssens et al.(Nov. 2009) "Comparative Analysis of the Widespread and Conserved PB1-like Viruses Infecting Pseudomonas Aeruginosa",Environmental Microbiology,11(11):2874-2883.

* cited by examiner

*Primary Examiner* — Shanon A. Foley
*Assistant Examiner* — Myron G Hill
(74) *Attorney, Agent, or Firm* — Mintz, Levin, Cohn, Ferris, Glovsky and Popeo, P.C.

(57) ABSTRACT

The present disclosure relates to bacteriophages and compositions capable of infecting and killing *Pseudomonas*, and use of the same for treating *Pseudomonas*, e.g. *Pseudomonas aeruginosa*, bacterial infections.

21 Claims, 12 Drawing Sheets

Specification includes a Sequence Listing.

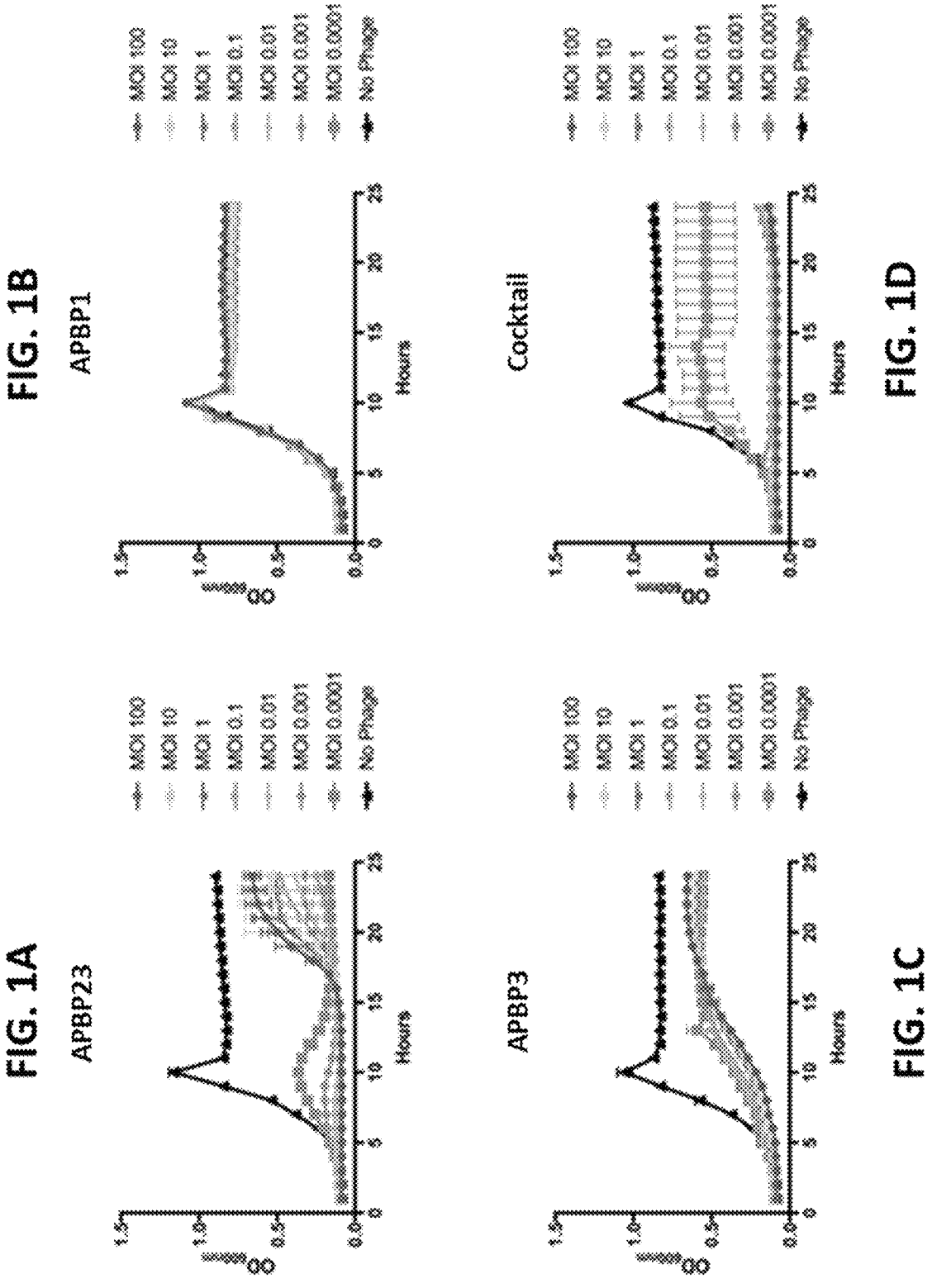

A. baumanii

E. coli

K. pneumoniae

S. aureus

S. epidermidis

E. faecalis

BACTERIOPHAGE COMPOSITIONS FOR TREATING *PSEUDOMONAS* INFECTION

CROSS-REFERENCES TO RELATED APPLICATIONS

This application claims the benefit of U.S. Provisional Application No. 63/016,132, filed Apr. 27, 2020, which is incorporated herein by reference in its entirety and for all purposes.

SEQUENCE LISTING

The instant application contains a Sequence Listing, which has been submitted electronically in ASCII format and is hereby incorporated by reference in its entirety. Said ASCII copy, created on Apr. 27, 2021 is named 054249-518001WO_ST25.txt and is 1.92 megabytes in size.

BACKGROUND

There is an increasing demand for alternative antibiotics as the number of bacterial strains resistant to traditional, small molecule antibiotic treatment regimens are becoming more numerous. Bacteriophage therapy uses bacterial viruses, or phages, to target and destroy bacteria at various sites of infection. Recent advances in biotechnology have allowed for the fast expansion of existing phage libraries in order to generate potent and specific phages that can target and destroy a bacterium of interest. *Pseudomonas aeruginosa* (PA) is an opportunistic pathogen that can potentially cause severe chronic and acute infections, especially in immune-compromised patients. PA infections are particularly high-risk for cystic fibrosis (CF) patients, where extensive PA colonization can take place in their lungs. Indeed, approximately 60% of people with CF have chronic PA pulmonary infection, in part due to the extra mucus providing an ideal environment for PA biofilm formation. Additionally, there are strains of PA that are antibiotic resistant, increasing the difficulty in treating these CF-related chronic infections. Bacteriophage treatment approaches that can circumvent traditional mechanisms of antibiotic resistance, avoid the toxic side effects of traditional small molecule therapies, and can be effective against biofilms, are especially attractive.

Thus, there is a large unmet need for a more efficient, potent, and specific anti-PA therapy to replace or augment the traditional small molecule antibiotics currently used to treat PA infections today.

SUMMARY

Described herein are bacteriophages, compositions of bacteriophages, combinations of phages, and use of the same for medical and non-medical applications, including in the treatment of bacterial infections and illnesses.

The various aspects and embodiments described herein are based at least in part, on significant and non-trivial inventive efforts. The discovery and development of individual bacteriophage, and combinations of bacteriophages, that can be used effectively to treat bacterial infections, such as for example, *Pseudomonas* infections, requires overcoming various technical hurdles and challenges. An individual bacteriophage may lack lytic capability and may lack adequate potency. For example, a phage may lack the ability to infect a bacterium adequately or at all, may lack the ability to produce sufficient progeny once infected, may lack the ability to infect a broad enough range of bacteria, may lack the ability to be formulated, manufactured and maintained, etc. In the case of combinations of phage, for example cocktails, there are additional technical challenges and hurdles. An individual bacteriophage that overcomes at least some of the above-mentioned technical challenges, still may not function in a cocktail or combination with other bacteriophages. The individual bacteriophage not only need to have adequate potency or efficacy individually, but also need some efficacy when used together.

Various technical hurdles can be considered in selecting bacteriophages for use in combination. For example, in some cases, it can be helpful to select two or more bacteriophages that come from different genera and/or families. Another consideration is whether the bacteriophages target different bacterial receptor classes. This can help, in some cases, avoid bacterial resistance against a cocktail. Still another is whether the bacteriophages are cooperative and compatible when used together. The embodiments and aspects described herein, including the individual phage and combinations of those phage, are based at least in part on overcoming technical challenges in discovering and developing individual bacteriophages and combinations of the same for use in the treating bacterial infections.

In some aspects, the present disclosure provides a bacteriophage composition comprising one or more bacteriophages comprising a polynucleotide sequence selected from the polynucleotide sequence of SEQ ID NO: 1, a polynucleotide sequence of SEQ ID NO: 2, a polynucleotide sequence of SEQ ID NO: 3, a polynucleotide sequence with at least 90% identity to SEQ ID NO: 1, a polynucleotide sequence with at least 90% identity to SEQ ID NO: 2, and/or a polynucleotide sequence with at least 90% identity to SEQ ID NO: 3.

In some embodiments, the bacteriophage composition may comprise two or more bacteriophages, wherein a first bacteriophage of the two or more bacteriophages comprises a polynucleotide sequence selected from the polynucleotide sequence of SEQ ID NO: 1, a polynucleotide sequence of SEQ ID NO: 2, or a polynucleotide sequence of SEQ ID NO: 3, and wherein a second bacteriophage of the two or more bacteriophages comprises a naturally occurring phage.

In some embodiments, the bacteriophage composition may comprise two or more bacteriophages comprising a polynucleotide sequence selected from the polynucleotide sequence of SEQ ID NO: 1, the polynucleotide sequence of SEQ ID NO: 2, the polynucleotide sequence of SEQ ID NO: 3, the polynucleotide sequence with at least 90% identity to SEQ ID NO: 1, the polynucleotide sequence with at least 90% identity to SEQ ID NO: 2, and/or the polynucleotide sequence with at least 90% identity to SEQ ID NO: 3.

In some embodiments, the bacteriophage composition's target bacteria range is broader than the cumulative range of the individual bacteriophages in the composition. In some embodiments, the target bacteria range is broadened within a bacterial species that the bacteriophage is able to infect.

In some embodiments, the bacteriophage composition may further comprise at least one bacteriophage comprising a polynucleotide sequence selected from the polynucleotide sequence of SEQ ID NO: 4, the polynucleotide sequence of SEQ ID NO: 5, the polynucleotide sequence of SEQ ID NO: 6, a polynucleotide sequence with at least 90% identity to SEQ ID NO: 4, a polynucleotide sequence with at least 90% identity to SEQ ID NO: 5, and a polynucleotide sequence with at least 90% identity to SEQ ID NO: 6.

In some embodiments, the bacteriophage composition may comprise one or more bacteriophages comprising a polynucleotide sequence selected from the polynucleotide sequence of SEQ ID NO: 4, a polynucleotide sequence of SEQ ID NO: 5, a polynucleotide sequence of SEQ ID NO: 6, a polynucleotide sequence with at least 90% identity to SEQ ID NO: 4, a polynucleotide sequence with at least 90% identity to SEQ ID NO: 5, and/or a polynucleotide sequence with at least 90% identity to SEQ ID NO:6.

In some embodiments, the bacteriophage composition may comprise two or more bacteriophages, wherein a first bacteriophage of the two or more bacteriophages comprises a polynucleotide sequence selected from the polynucleotide sequence of SEQ ID NO: 4, a polynucleotide sequence of SEQ ID NO: 5, or a polynucleotide sequence of SEQ ID NO: 6, and wherein a second bacteriophage of the two or more bacteriophages comprises a naturally occurring phage.

In some embodiments, the bacteriophage composition may comprise two or more bacteriophages comprising a polynucleotide sequence selected from the polynucleotide sequence of SEQ ID NO: 4, the polynucleotide sequence of SEQ ID NO: 5, the polynucleotide sequence of SEQ ID NO: 6, the polynucleotide sequence with at least 90% identity to SEQ ID NO: 4, the polynucleotide sequence with at least 90% identity to SEQ ID NO: 5, and/or the polynucleotide sequence with at least 90% identity to SEQ ID NO: 6.

In some embodiments, the bacteriophage composition's target bacteria range is broader than the cumulative range of the individual bacteriophage in the composition. In some embodiments, the target bacteria range is broadened within a bacterial species that the bacteriophage is able to infect.

In another aspect, the present disclosure provides an isolated, purified bacteriophage comprising a polynucleotide sequence of SEQ ID NO: 1. In another aspect, the present disclosure provides an isolated, purified bacteriophage comprising a polynucleotide sequence with at least 90% identity to SEQ ID NO: 1. In another aspect, the present disclosure provides an isolated, purified bacteriophage comprising a polynucleotide sequence SEQ ID NO: 2. In another aspect, the present disclosure provides an isolated, purified bacteriophage comprising a polynucleotide sequence with at least 90% identity to SEQ ID NO: 2. In another aspect, the present disclosure provides an isolated, purified bacteriophage comprising a polynucleotide sequence of SEQ ID NO: 3. In another aspect, the present disclosure provides an isolated, purified bacteriophage comprising a polynucleotide sequence with at least 90% identity to SEQ ID NO: 3. In another aspect, the present disclosure provides an isolated, purified bacteriophage comprising a polynucleotide sequence of SEQ ID NO: 4. In another aspect, the present disclosure provides an isolated, purified bacteriophage comprising a polynucleotide sequence with at least 90% identity to SEQ ID NO: 4. In another aspect, the present disclosure provides an isolated, purified bacteriophage comprising a polynucleotide sequence of SEQ ID NO: 5. In another aspect, the present disclosure provides an isolated, purified bacteriophage comprising a polynucleotide sequence with at least 90% identity to SEQ ID NO: 5. In another aspect, the present disclosure provides an isolated, purified bacteriophage comprising a polynucleotide sequence of SEQ ID NO: 6. In another aspect, the present disclosure provides an isolated, purified bacteriophage comprising a polynucleotide sequence with at least 90% identity to SEQ ID NO: 6. In another aspect, the present disclosure provides an isolated, purified bacteriophage comprising a polynucleotide sequence of SEQ ID NO: 7. In another aspect, the present disclosure provides an isolated, purified bacteriophage comprising a polynucleotide sequence with at least 90% identity to SEQ ID NO: 7. In another aspect, the present disclosure provides an isolated, purified bacteriophage comprising a polynucleotide sequence of SEQ ID NO: 8. In another aspect, the present disclosure provides an isolated, purified bacteriophage comprising a polynucleotide sequence with at least 90% identity to SEQ ID NO: 8. In another aspect, the present disclosure provides an isolated, purified bacteriophage comprising a polynucleotide sequence of SEQ ID NO: 9. In another aspect, the present disclosure provides an isolated, purified bacteriophage comprising a polynucleotide sequence with at least 90% identity to SEQ ID NO: 9. In another aspect, the present disclosure provides an isolated, purified bacteriophage comprising a polynucleotide sequence of SEQ ID NO: 10. In another aspect, the present disclosure provides an isolated, purified bacteriophage comprising a polynucleotide sequence with at least 90% identity to SEQ ID NO: 10. In another aspect, the present disclosure provides an isolated, purified bacteriophage comprising a polynucleotide sequence of SEQ ID NO: 11. In another aspect, the present disclosure provides an isolated, purified bacteriophage comprising a polynucleotide sequence with at least 90% identity to SEQ ID NO: 11. In another aspect, the present disclosure provides an isolated, purified bacteriophage comprising a polynucleotide sequence of SEQ ID NO: 12. In another aspect, the present disclosure provides an isolated, purified bacteriophage comprising a polynucleotide sequence with at least 90% identity to SEQ ID NO: 12. In another aspect, the present disclosure provides an isolated, purified bacteriophage comprising a polynucleotide sequence of SEQ ID NO: 13. In another aspect, the present disclosure provides an isolated, purified bacteriophage comprising a polynucleotide sequence with at least 90% identity to SEQ ID NO: 13. In another aspect, the present disclosure provides an isolated, purified bacteriophage comprising a polynucleotide sequence of SEQ ID NO: 14. In another aspect, the present disclosure provides an isolated, purified bacteriophage comprising a polynucleotide sequence with at least 90% identity to SEQ ID NO: 14. In another aspect, the present disclosure provides an isolated, purified bacteriophage comprising a polynucleotide sequence of SEQ ID NO: 15. In another aspect, the present disclosure provides an isolated, purified bacteriophage comprising a polynucleotide sequence with at least 90% identity to SEQ ID NO: 15. In another aspect, the present disclosure provides an isolated, purified bacteriophage comprising a polynucleotide sequence of SEQ ID NO: 16. In another aspect, the present disclosure provides an isolated, purified bacteriophage comprising a polynucleotide sequence with at least 90% identity to SEQ ID NO: 16. In another aspect, the present disclosure provides an isolated, purified bacteriophage comprising a polynucleotide sequence of SEQ ID NO: 17. In another aspect, the present disclosure provides an isolated, purified bacteriophage comprising a polynucleotide sequence with at least 90% identity to SEQ ID NO: 17. In another aspect, the present disclosure provides an isolated, purified bacteriophage comprising a polynucleotide sequence of SEQ ID NO: 18. In another aspect, the present disclosure provides an isolated, purified bacteriophage comprising a polynucleotide sequence with at least 90% identity to SEQ ID NO: 18. In another aspect, the present disclosure provides an isolated, purified bacteriophage comprising a polynucleotide sequence of SEQ ID NO: 19. In another aspect, the present disclosure provides an isolated, purified bacteriophage comprising a polynucleotide sequence with at least 90% identity to SEQ ID NO: 19. In another aspect, the present disclosure provides an isolated, purified bacteriophage comprising a polynucleotide sequence of SEQ ID NO: 20. In another aspect, the present disclosure provides an isolated, purified bacteriophage comprising a polynucleotide sequence with at least 90% identity to SEQ ID NO: 20. In another aspect, the present disclosure provides an isolated, purified bacteriophage comprising a polynucleotide sequence of SEQ ID NO: 21. In another aspect, the present disclosure provides an isolated, purified bacteriophage comprising a polynucleotide sequence with at least 90% identity to SEQ ID NO: 21. In another aspect, the present disclosure provides an isolated, purified bacteriophage comprising a polynucleotide sequence of SEQ ID NO: 22. In another aspect, the present disclosure provides an isolated, purified bacteriophage comprising a polynucleotide sequence with at least 90% identity to SEQ ID NO: 22.

In some embodiments, the bacteriophage is resistant to sputum inactivation. In some embodiments, the bacteriophage persists in the lung and/or bronchoalveolar lavage fluid up to 48 hours after administration.

In some embodiments, the bacteriophage maintains activity in the presence of a pulmonary treatment selected from salbutamol, tobramycin, aztreonam, colistin, inhaled hypertonic saline, and inhaled beta-agonist.

In yet another aspect, the present disclosure provides a bacteriophage composition comprising two or more bacteriophages, wherein at least one of the bacteriophages comprises a polynucleotide sequence having at least 90% identity to a sequence selected from the polynucleotide sequence of SEQ ID NO: 1, 2, 3, 4, 5, 6, 7, 8, 9, 10, 11, 12, 13, 14, 15, 16, 17, 18, 19, 20, 21, and 22; and wherein at least one other bacteriophage infects a *Pseudomonas* bacterium.

In some embodiments, the composition comprises at least two bacteriophages where each bacteriophage comprises a separate polynucleotide sequence having at least 90% identity to a sequence selected from the polynucleotide sequence of SEQ ID NO: 1, 2, 3, 4, 5, 6, 7, 8, 9, 10, 11, 12, 13, 14, 15, 16, 17, 18, 19, 20, 21, and 22.

In some embodiments, the composition comprises at least three bacteriophages where each bacteriophage comprises a separate polynucleotide sequence having at least 90% identity to a sequence selected from the polynucleotide sequence of SEQ ID NO: 1, 2, 3, 4, 5, 6, 7, 8, 9, 10, 11, 12, 13, 14, 15, 16, 17, 18, 19, 20, 21, and 22.

In some embodiments, the composition comprises at least one bacteriophage comprising a sequence having at least 90% identity to a sequence selected from the polynucleotide sequence of SEQ ID NO: 1, 2, 3, 4, 5, and 6.

In some embodiments, the composition comprises at least two bacteriophages, each bacteriophage comprising a different polynucleotide sequence having at least 90% identity to a sequence selected from the polynucleotide sequence of SEQ ID NO: 1, 2, 3, 4, 5, and 6.

In some embodiments, the composition further comprises at least one bacteriophage comprising a polynucleotide sequence having at least 90% identity to a sequence selected from 7, 8, 9, 10, 11, 12, 13, 14, 15, 16, 17, 18, 19, 20, 21, and 22.

In yet another aspect, the present disclosure provides a bacteriophage composition comprising one or more bacteriophages comprising a polynucleotide sequence having 90% to 100% identity to a sequence selected from the polynucleotide sequence of SEQ ID NO: 1, a polynucleotide sequence of SEQ ID NO: 2, a polynucleotide sequence of SEQ ID NO: 3, a polynucleotide sequence of SEQ ID NO: 4, a polynucleotide sequence of SEQ ID NO: 5, a polynucleotide sequence of SEQ ID NO: 6.

In some embodiments, the composition may comprise two or more bacteriophages selected from the polynucleotide sequence of SEQ ID NO: 1, a polynucleotide sequence of SEQ ID NO: 2, a polynucleotide sequence of SEQ ID NO: 3, a polynucleotide sequence of SEQ ID NO: 4, a polynucleotide sequence of SEQ ID NO: 5, or a polynucleotide sequence of SEQ ID NO: 6.

In some embodiments, the bacteriophage composition may comprise three or more bacteriophages selected from the polynucleotide sequence of SEQ ID NO: 1, a polynucleotide sequence of SEQ ID NO: 2, a polynucleotide sequence of SEQ ID NO: 3, a polynucleotide sequence of SEQ ID NO: 4, a polynucleotide sequence of SEQ ID NO: 5, or a polynucleotide sequence of SEQ ID NO: 6.

In some embodiments, th bacteriophage composition may comprise four or more bacteriophages selected from the polynucleotide sequence of SEQ ID NO: 1, a polynucleotide sequence of SEQ ID NO: 2, a polynucleotide sequence of SEQ ID NO: 3, a polynucleotide sequence of SEQ ID NO: 4, a polynucleotide sequence of SEQ ID NO: 5, or a polynucleotide sequence of SEQ ID NO: 6.

In some embodiments, the bacteriophage composition may comprise five or more bacteriophages selected from the polynucleotide sequence of SEQ ID NO: 1, a polynucleotide sequence of SEQ ID NO: 2, a polynucleotide sequence of SEQ ID NO: 3, a polynucleotide sequence of SEQ ID NO: 4, a polynucleotide sequence of SEQ ID NO: 5, or a polynucleotide sequence of SEQ ID NO: 6.

In some embodiments, the bacteriophage composition may further comprise a bacteriophage comprising a nucleic acid sequence having 90%-100% identity to a sequence selected from a polynucleotide sequence of SEQ ID NO: 7, a polynucleotide sequence of SEQ ID NO: 8, a polynucleotide sequence of SEQ ID NO: 9, a polynucleotide sequence of SEQ ID NO: 10, a polynucleotide sequence of SEQ ID NO: 11, a polynucleotide sequence of SEQ ID NO: 12, a polynucleotide sequence of SEQ ID NO: 13, a polynucleotide sequence of SEQ ID NO: 14, a polynucleotide sequence of SEQ ID NO: 15, a polynucleotide sequence of SEQ ID NO: 16, a polynucleotide sequence of SEQ ID NO: 17, a polynucleotide sequence of SEQ ID NO: 18, a polynucleotide sequence of SEQ ID NO: 19, a polynucleotide sequence of SEQ ID NO: 20, a polynucleotide sequence of SEQ ID NO: 21, a polynucleotide sequence of SEQ ID NO: 22.

In some embodiments, the bacteriophage composition comprises a polynucleotide sequence with at least a 90% identity to SEQ ID NO: 7, a polynucleotide with at least a 93% identity to SEQ ID NO: 8, a polynucleotide sequence with at least 93% identity to SEQ ID NO: 9, a polynucleotide sequence with at least 89% identity to SEQ ID NO: 10, a polynucleotide sequence with at least 95% identity to SEQ ID NO: 11, a polynucleotide sequence with at least 91% identity to SEQ ID NO: 12, a polynucleotide sequence with at least 92% identity to SEQ ID NO: 13, a polynucleotide sequence with at least 96% identity to SEQ ID NO: 14 a polynucleotide sequence with at least 95% identity to SEQ ID NO: 15, a polynucleotide sequence with at least 90% identity to SEQ ID NO: 16, a polynucleotide sequence with at least 92% identity to SEQ ID NO: 17, a polynucleotide sequence with at least 95% identity to SEQ ID NO: 18, a polynucleotide sequence with at least 96% identity to SEQ ID NO: 19, a polynucleotide sequence with at least 96% identity to SEQ ID NO: 20, a polynucleotide sequence with at least 96% identity to SEQ ID NO: 21, a polynucleotide sequence with at least 95% identity to SEQ ID NO: 22.

Each of these phages can be administered individually or together in a cocktail. Any individual bacteriophage listed in a combination cocktail can be administered in separate formulations or in a single formulation.

In some embodiments, at least one of the bacteriophages of the bacteriophage composition infect and kill *Pseudomonas aeruginosa*.

In some embodiments, the bacteriophage composition further comprises a storage medium for storage at room temperature or a temperature at or below 8° C. In some embodiments, the storage medium comprises a cryoprotectant.

In some embodiments, the bacteriophage of the composition is resistant to sputum inactivation.

In some embodiments, the bacteriophage remains in the lung and/or bronchoalveolar lavage fluid up to 72 hours after administration.

In some embodiments, the bacteriophage maintains activity in the presence of a pulmonary treatment selected from salbutamol, tobramycin, aztreonam, colistin, inhaled hypertonic saline, and inhaled beta-agonist.

In some embodiments, one or more bacteriophages belong to the Family Podoviridae or Myoviridae.

In some embodiments, one or more phage belong to the Family Myoviridae. In some embodiments, one or more phage belong to the Genus Pbunavirus. In some embodiments, one or more phage belong to the Genus Pakpunavirus. In some embodiments, one or more phage belong to the Genus Nankokuvirus.

In some embodiments, one or more phage belong to the Family Podoviridae. In some embodiments, one or more phage belong to the Genus Phikmvvirus. In some embodiments, one or more phage belong to the Genus Litunavirus. In some embodiments, one or more phage belong to the Genus Bruynoghevirus. In some embodiments, one or more phage belong to the Genus Luzseptimavirus.

In some embodiments, the composition comprises a bacteriophage comprising a polynucleotide sequence with at least 90% identity to SEQ ID NO: 1. In some embodiments, the composition comprises a bacteriophage comprising the polynucleotide sequence of SEQ ID NO: 1.

In some embodiments, the composition comprises a bacteriophage comprising a polynucleotide sequence with at least 90% identity to SEQ ID NO: 2. In some embodiments, the composition comprises a bacteriophage comprising the polynucleotide sequence of SEQ ID NO: 2.

In some embodiments, the composition comprises a bacteriophage comprising a polynucleotide sequence with at least 90% identity to SEQ ID NO: 3. In some embodiments, the composition comprises a bacteriophage comprising the polynucleotide sequence of SEQ ID NO: 3.

In some embodiments, the composition comprises a bacteriophage comprising a polynucleotide sequence with at least 90% identity to SEQ ID NO: 4. In some embodiments, the composition comprises a bacteriophage comprising the polynucleotide sequence of SEQ ID NO: 4.

In some embodiments, the composition comprises a bacteriophage comprising a polynucleotide sequence with at least 90% identity to SEQ ID NO: 5. In some embodiments, the composition comprises a bacteriophage comprising the polynucleotide sequence of SEQ ID NO: 5.

In some embodiments, the composition comprises a bacteriophage comprising a polynucleotide sequence with at least 90% identity to SEQ ID NO: 6. In some embodiments, the composition comprises a bacteriophage comprising the polynucleotide sequence of SEQ ID NO: 6.

In some embodiments, the composition is substantially free of a bacterial component. In some embodiments, the bacterial component comprises bacterial host protein and/or exotoxin.

In some embodiments, the composition further comprises a pharmaceutically acceptable carrier, diluent, excipient or combinations thereof.

In some embodiments, the composition is formulated for nebulization. In some embodiments, the composition is a liquid, semi-liquid, solid, frozen, or lyophilized formulation.

In some embodiments, the bacteriophage of the composition targets one or more of *Pseudomonas aeruginosa*, antibiotic-resistant *Pseudomonas aeruginosa*, and multiple antibiotic-resistant *Pseudomonas aeruginosa*.

In some embodiments, the bacteriophages infect and kill one or more of *Pseudomonas aeruginosa*, antibiotic-resistant *Pseudomonas aeruginosa*, and multiple antibiotic-resistant *Pseudomonas aeruginosa*.

In some embodiments, the composition comprises between $1 \times 10^8$ and $1 \times 10^{11}$ PFU per milliliter of each bacteriophage. In some embodiments, the composition is to be administered at a dosage of at least $3 \times 10^8$ PFU of total bacteriophages per milliliter per dose.

In some embodiments, the composition is stored at a temperature ranging from −20° C. to 25° C. In some embodiments, the composition is stored at 2° C. to 8° C.

In some embodiments, at least one bacteriophage is obligately lytic.

In some embodiments, the sequence of at least one bacteriophage is genetically modified.

In yet another aspect, the present disclosure provides a bacteriophage composition comprising, consisting essentially of, or consisting of a bacteriophage comprising a polynucleotide sequence of SEQ ID NO: 1, a bacteriophage comprising a polynucleotide sequence of SEQ ID NO: 2, and a bacteriophage comprising a polynucleotide sequence of SEQ ID NO: 3.

In yet another aspect, the present disclosure provides a bacteriophage composition comprising, consisting essentially of, or consisting of a bacteriophage comprising a polynucleotide sequence of SEQ ID NO: 4, a bacteriophage comprising a polynucleotide sequence of SEQ ID NO: 5, and a bacteriophage comprising a polynucleotide sequence of SEQ ID NO: 6.

In some embodiments, the bacteriophage composition may further comprise one or more bacteriophages selected from a bacteriophage comprising a polynucleotide sequence with 90%-100% identity to a sequence of SEQ ID NO: 4, a bacteriophage comprising a polynucleotide sequence of SEQ ID NO: 5, a bacteriophage comprising a polynucleotide sequence of SEQ ID NO: 6, a bacteriophage comprising a polynucleotide sequence of SEQ ID NO: 7, a bacteriophage comprising a polynucleotide sequence of SEQ ID NO: 8, a bacteriophage comprising a polynucleotide sequence of SEQ ID NO: 9, a bacteriophage comprising a polynucleotide sequence of SEQ ID NO: 10, a bacteriophage comprising a polynucleotide sequence of SEQ ID NO: 11, a bacteriophage comprising a polynucleotide sequence of SEQ ID NO: 12, a bacteriophage comprising a polynucleotide sequence of SEQ ID NO: 13, a bacteriophage comprising a polynucleotide sequence of SEQ ID NO: 14, a bacteriophage comprising a polynucleotide sequence of SEQ ID NO: 15, a bacteriophage comprising a polynucleotide sequence of SEQ ID NO: 16, a bacteriophage comprising a polynucleotide sequence of SEQ ID NO: 17, a bacteriophage comprising a polynucleotide sequence of SEQ ID NO: 18, a bacteriophage comprising a polynucleotide sequence of SEQ ID NO: 19, a bacteriophage comprising a polynucleotide sequence of SEQ ID NO: 20, a bacteriophage comprising a polynucleotide sequence of SEQ ID NO: 21, or a bacteriophage comprising a polynucleotide sequence of SEQ ID NO: 22.

In yet another aspect, the present disclosure provides a bacteriophage composition comprising: a bacteriophage comprising a polynucleotide sequence with at least 90% identity to SEQ ID NO: 1, a bacteriophage comprising a polynucleotide sequence with at least 90% identity to SEQ ID NO: 2, and a bacteriophage comprising polynucleotide sequence with at least 90% identity to SEQ ID NO: 3.

In yet another aspect, the present disclosure provides a bacteriophage composition comprising: a bacteriophage comprising a polynucleotide sequence with at least 90% identity to SEQ ID NO: 4, a bacteriophage comprising a polynucleotide sequence with at least 90% identity to SEQ ID NO: 5, and a bacteriophage comprising polynucleotide sequence with at least 90% identity to SEQ ID NO:6.

In some embodiments, the bacteriophage composition may further comprise one or more bacteriophages selected from a bacteriophage comprising a polynucleotide sequence with at least 90% identity to SEQ ID NO: 4, 5, 6, 7, 8, 9, 10, 11, 12, 13, 14, 15, 16, 17, 18, 19, 20, 21, and 22.

In some embodiments, the one or more bacteriophages comprise a polynucleotide sequence with at least 90% identity to SEQ ID NO: 7, a bacteriophage comprising a polynucleotide sequence with at least 93% identity to SEQ ID NO: 8, a bacteriophage comprising a polynucleotide sequence with at least 93% identity to SEQ ID NO: 9, a bacteriophage comprising a polynucleotide sequence with at least 89% identity to SEQ ID NO: 10, a bacteriophage comprising a polynucleotide sequence with at least 95% identity to SEQ ID NO: 11, a bacteriophage comprising a polynucleotide sequence with at least 91% identity to SEQ ID NO: 12, a bacteriophage comprising a polynucleotide sequence with at least 92% identity to SEQ ID NO: 13, a bacteriophage comprising a polynucleotide sequence with at least 96% identity to SEQ ID NO: 14, a bacteriophage comprising a polynucleotide sequence with at least 95% identity to SEQ ID NO: 15, a bacteriophage comprising a polynucleotide sequence with at least 90% identity to SEQ ID NO: 16, a bacteriophage comprising a polynucleotide sequence with at least 92% identity to SEQ ID NO: 17, a bacteriophage comprising a polynucleotide sequence with at least 95% identity to SEQ ID NO: 18, a bacteriophage comprising a polynucleotide sequence with at least 96% identity to SEQ ID NO: 19, a bacteriophage comprising a polynucleotide sequence with at least 96% identity to SEQ ID NO: 20, a bacteriophage comprising a polynucleotide sequence with at least 96% identity to SEQ ID NO: 21, or a bacteriophage comprising a polynucleotide sequence with at least 95% identity to SEQ ID NO: 22.

In some embodiments, the composition's target bacteria range is broader than the cumulative range of the individual bacteriophages in the composition. In some embodiments, the target bacteria range is broadened within a bacterial species that the bacteriophage is able to infect.

In some embodiments, the bacteriophages infect and kill *Pseudomonas aeruginosa*.

In some embodiments, the composition is stored at a temperature ranging from −20-25° C. In some embodiments, the composition further comprises a storage medium for storage at a temperature at or below 8° C., such as at 4° C., 0° C., −20° C., or −80° C.

In some embodiments, the bacteriophage is resistant to sputum inactivation.

In some embodiments, the bacteriophage persists in the lung and/or bronchoalveolar lavage fluid up to 48 hours after administration.

In some embodiments, the bacteriophages reduce biofilm mass.

In some embodiments, the bacteriophage maintains activity in the presence of a pulmonary treatment selected from salbutamol, tobramycin, aztreonam, colistin, inhaled hypertonic saline, and inhaled beta-agonist.

In some embodiments, one or more bacteriophages belong to the Family Podoviridae and/or Myoviridae.

In some embodiments, the composition is substantially free of a bacterial component. In some embodiments, the bacterial component comprises bacterial host protein.

In some embodiments, the composition further comprises a pharmaceutically acceptable carrier, diluent, excipient or combinations thereof. In some embodiments, the composition is a liquid, semi-liquid, solid, frozen, or lyophilized formulation.

In some embodiments, the bacteriophage of the composition targets one or more of *Pseudomonas aeruginosa*, antibiotic-resistant *Pseudomonas aeruginosa*, and/or multiple antibiotic-resistant *Pseudomonas aeruginosa*. In some embodiments, the bacteriophages infect and kill one or more of *Pseudomonas aeruginosa*, antibiotic-resistant *Pseudomonas aeruginosa*, and/or multiple antibiotic-resistant *Pseudomonas aeruginosa*.

In some embodiments, the composition comprises between $1\times10^8$ and $1\times10^{11}$ PFU per milliliter of each bacteriophage. In some embodiments, the composition is to be administered at a dosage of at least $3\times10^8$ PFU of total bacteriophages per milliliter.

In some embodiments, the composition is stored at a temperature ranging from −20° C. to 25° C. In some embodiments, the composition is stored at 2° C. to 8° C.

In some embodiments, at least one bacteriophage is obligately lytic.

In some embodiments, the sequence of at least one bacteriophage is genetically modified.

In yet another aspect, the present disclosure provides a method of treating a bacterial infection comprising administering any of the bacteriophages or compositions described herein.

In yet another aspect, the present disclosure provides a use of any of the compositions described herein in the treatment of a *Pseudomonas aeruginosa* infection in a subject, the use comprising administering the composition to a subject suffering from a *Pseudomonas aeruginosa* infection.

In yet another aspect, the present disclosure provides a use of any of the compositions described herein comprising one or more distinct bacteriophages that target *Pseudomonas aeruginosa* in the treatment of subject with a *Pseudomonas aeruginosa* bacterial infection comprising administering the composition to said subject; wherein at least one of said one or more bacteriophages is selected from a bacteriophage comprising a polynucleotide sequence of SEQ ID NO: 1, SEQ ID NO: 2, SEQ ID NO: 3, a polynucleotide sequence with at least 85% identity to SEQ ID NO: 1, a polynucleotide sequence with at least 85% identity to SEQ ID NO: 2, and a polynucleotide sequence with at least 85% identity to SEQ ID NO: 3.

In yet another aspect, the present disclosure provides a use of any of the compositions described herein comprising one or more distinct bacteriophages that target *Pseudomonas aeruginosa* in the treatment of subject with a *Pseudomonas aeruginosa* bacterial infection comprising administering the composition to said subject; wherein at least one of said one or more bacteriophages is selected from a bacteriophage comprising a polynucleotide sequence of SEQ ID NO: 4, SEQ ID NO: 5, SEQ ID NO: 6, a polynucleotide sequence with at least 85% identity to SEQ ID NO: 4, a polynucleotide sequence with at least 85% identity to SEQ ID NO: 5, and a polynucleotide sequence with at least 85% identity to SEQ ID NO: 6.

In yet another aspect, the present disclosure provides a use of any of the compositions described herein comprising one or more distinct bacteriophages that target *Pseudomonas aeruginosa* in the treatment of subject with a *Pseudomonas aeruginosa* bacterial infection comprising administering the composition to said subject; wherein at least one of said one or more bacteriophages is selected from a bacteriophage comprising a polynucleotide sequence of SEQ ID NO: 1, SEQ ID NO: 2, SEQ ID NO: 3, a polynucleotide sequence with at least 85% identity to SEQ ID NO: 1, a polynucleotide sequence with at least 85% identity to SEQ ID NO: 2, and a polynucleotide sequence with at least 85% identity to SEQ ID NO: 3; and at least one additional bacteriophage selected from a bacteriophage comprising a polynucleotide sequence of SEQ ID NO: 4, SEQ ID NO: 5, SEQ ID NO: 6, a polynucleotide sequence with at least 85% identity to SEQ ID NO: 4, a polynucleotide sequence with at least 85% identity to SEQ ID NO: 5, and a polynucleotide sequence with at least 85% identity to SEQ ID NO: 6.

In some embodiments, the use may comprise use of one or more bacteriophages comprising a nucleic acid sequence having 85%-100% sequence identity to a sequence selected from SEQ ID No. 7, 8, 9, 10, 11, 12, 13, 14, 15, 16, 17, 18, 19, 20, 21, and 22.

In some embodiments, the bacteriophage is resistant to sputum inactivation.

In yet another aspect, the present disclosure provides a method of treating a subject with a bacterial infection comprising selecting a bacteriophage based upon resistance to sputum inactivation and administering said bacteriophage to the subject.

In some embodiments, the bacteriophage is selected from a bacteriophage comprising a polynucleotide sequence selected from SEQ ID NO: 1, SEQ ID NO: 2, SEQ ID NO: 3, SEQ ID NO: 4, SEQ ID NO: 5, SEQ ID NO: 6, a polynucleotide sequence with at least 90% identity to SEQ ID NO: 1, a polynucleotide sequence with at least 90% identity to SEQ ID NO: 1, a polynucleotide sequence with at least 90% identity to SEQ ID NO: 2, and a polynucleotide sequence with at least 90% identity to SEQ ID NO: 3, a polynucleotide sequence with at least 90% identity to SEQ ID NO: 4, a polynucleotide sequence with at least 90% identity to SEQ ID NO: 5, and a polynucleotide sequence with at least 90% identity to SEQ ID NO: 6.

In some embodiments, the bacteriophage is selected from a bacteriophage comprising a polynucleotide sequence with 80%-100% identity to a sequence selected from SEQ ID NO: 7, 8, 9, 10, 11, 12, 13, 14, 15, 16, 17, 18, 19, 20, 21, and 22.

In yet another aspect, the present disclosure provides a method of treating a subject with a bacterial infection comprising administering to the subject one or more distinct bacteriophages selected from a bacteriophage comprising a polynucleotide sequence having 85%-100% identity to a sequence selected from SEQ ID NO: 1, 2, 3, 4, 5, 6, 7, 8, 9, 10, 11, 12, 13, 14, 15, 16, 17, 18, 19, 20, 21, and 22.

In some embodiments, the one or more bacteriophages comprise a bacteriophage selected from a bacteriophage comprising a polynucleotide sequence having 85%-100% identity to a sequence selected from SEQ ID NO: 1, 2, 3, 4, 5, and 6.

In some embodiments, the method comprises at least two bacteriophages, and at least one of the at least two bacteriophages is a bacteriophage selected from a bacteriophage comprising a polynucleotide sequence having 85%-100% identity to a sequence selected from SEQ ID NO: 1, 2, 3, 4, 5, and 6.

In some embodiments, the bacteriophage comprises a polynucleotide sequence having at least 85% identity to a sequence selected from SEQ ID NO: 1, 2, 3, 4, 5, and 6. In some embodiments, the bacteriophage comprises a polynucleotide sequence having at least 90% identity to a sequence selected from SEQ ID NO: 1, 2, 3, 4, 5, and 6. In some embodiments, the bacteriophage comprises a polynucleotide sequence having at least 95% identity to a sequence selected from SEQ ID NO: 1, 2, 3, 4, 5, and 6. In some embodiments, the bacteriophage comprises a polynucleotide sequence having at least 99% identity to a sequence selected from SEQ ID NO: 1, 2, 3, 4, 5, and 6. In some embodiments, the bacteriophage comprises a polynucleotide sequence selected from SEQ ID NO: 1, 2, 3, 4, 5, and 6.

In some embodiments, the method may further comprise one or more bacteriophages comprising a polynucleotide sequence having 85%-100% identity to a sequence selected from SEQ ID NO: 7, 8, 9, 10, 11, 12, 13, 14, 15, 16, 17, 18, 19, 20, 21, and 22.

In some embodiments, the one or more bacteriophages comprise a bacteriophage selected from a bacteriophage comprising a polynucleotide sequence having 85%-100% identity to a sequence selected from SEQ ID NO: 1, SEQ ID NO: 2, and SEQ ID NO: 3.

In some embodiments, the one or more distinct bacteriophages are selected from a bacteriophage comprising a polynucleotide sequence having 85%-100% identity to a sequence selected from SEQ ID NO: 4, SEQ ID NO: 5, and SEQ ID NO: 6.

In some embodiments, the bacterial infection is at least partially due to *Pseudomonas aeruginosa*.

In some embodiments, the one or more distinct bacteriophages infect and kill *Pseudomonas aeruginosa*.

In some embodiments, the bacteriophages are the primary treatment. In some embodiments, the bacteriophages are applied to an infection that was previously unresolved by treatment with antibiotics.

In some embodiments, at least about 80% of bacteriophages retain lytic activity after exposure to human plasma for a time period between about 10 minutes and about 100 minutes. In some embodiments, the time period is between about 10 minutes and about 90 minutes.

In some embodiments, the bacterial infection comprises a pulmonary infection, and/or rhinosinusitis. In some embodiments, the subject has a bacterial infection and a lung fibrosis condition. In some embodiments, the infection comprises a bacterial infection in the presence of cystic fibrosis, non-cystic fibrosis bronchiectasis (NCFB), and/or pneumonia.

In some embodiments, the bacterial infection is resistant to an antibiotic.

In some embodiments, the bacteriophages are administered in combination with an antibiotic class selected from a fluoroquinolone, carbapenem, aminoglycoside, ansamycin, cephalosporin, penicillin, beta lactam, beta lactamase inhibitor, folate pathway inhibitor, fucidane, glycopeptide, glycylcycline, lincosamide, lipopeptide, macrolide, quinolone, oxazolidinone, phenicol phosphonic acid, streptogramin, tetracycline, sulfonamide, imipenem, meropenem, amikacin, ciprofloxacin, levofloxacin, tobramycin, azithromycin, aztreonam, colistin, inhaled tobramycin, inhaled aztreonam, and inhaled colistin.

In some embodiments, the bacterial infection has become resistant to antibiotics selected from a fluoroquinolone, carbapenem, aminoglycoside, ansamycin, cephalosporin, penicillin, beta lactam, beta lactamase inhibitor, folate pathway inhibitor, fucidane, glycopeptide, glycylcycline, lincosamide, lipopeptide, macrolide, quinolone, oxazolidinone, phenicol phosphonic acid, streptogramin, tetracycline, sulfonamide, imipenem, meropenem, amikacin, ciprofloxacin, levofloxacin, tobramycin, azithromycin, aztreonam, colistin, inhaled tobramycin, inhaled aztreonam, and inhaled colistin.

In some embodiments, the bacteriophages are administered at between $1 \times 10^8$ and $1 \times 10^{11}$ PFU of each bacteriophage.

In some embodiments, the bacteriophages are administered at least $3 \times 10^8$ plaque forming units (PFU) of total bacteriophages.

In some embodiments, the bacteriophage is administered in a dosage comprising at least about $1 \times 10^8$ PFU of each bacteriophage.

In some embodiments, the method further comprises administration of an antibiotic. In some embodiments, the antibiotic is a fluoroquinolone, carbapenem, aminoglycoside, ansamycin, cephalosporin, penicillin, beta lactam, beta lactamase inhibitor, folate pathway inhibitor, fucidane, glycopeptide, glycylcycline, lincosamide, lipopeptide, macrolide, quinolone, oxazolidinone, phenicol phosphonic acid, streptogramin, tetracycline, sulfonamide, imipenem, meropenem, amikacin, ciprofloxacin, levofloxacin, tobramycin, azithromycin, aztreonam, colistin, inhaled tobramycin, inhaled aztreonam, or inhaled colistin.

In some embodiments, the method further comprises administration of a treatment for cystic fibrosis. In some embodiments, the treatment for cystic fibrosis is selected from CFTR modulator therapies, mucus thinners, airway clearance techniques, inhaled corticosteroids, oral corticosteroids, leukotriene modifiers, inhaled anticholinergics, dornase alfa, inhaled bronchodilators, inhaled hypertonic saline, and inhaled beta-agonists.

In some embodiments, the bacteriophage is administered via inhalation. In some embodiments, the bacteriophage is administered via nebulization. In some embodiments, the bacteriophage is administered at least every 6 hours. In some embodiments, the bacteriophage is administered for at least one day.

In some embodiments, the subject is human.

In yet another aspect, the present disclosure provides a method of treating non-cystic fibrosis bronchiectasis (NCFB) comprising administering one or more bacteriophages that target bacteria in the genus *Pseudomonas*.

In some embodiments, the bacteriophages comprise one or more bacteriophages selected from the group consisting of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, and/or SEQ ID NO: 22.

In yet another aspect, the present disclosure provides a bacterial host manufacturing strain comprising a bacteriophage selected from a bacteriophage comprising a polynucleotide sequence having 85%-100% identity to a sequence of SEQ ID NO: 1-22.

In some embodiments, the bacteriophage comprises a sequence having at least 90% sequence identity to a polynucleotide sequence of SEQ ID NO: 1-22.

In yet another aspect, the present disclosure provides a method of treating a bacterial infection in a subject with cystic fibrosis comprising administering to the subject one or more distinct bacteriophages selected from a bacteriophage comprising a polynucleotide sequence having at least 90% identity to SEQ ID NO: 1, and SEQ ID NO: 3.

In some embodiments, the one or more distinct bacteriophages are selected from a bacteriophage comprising a polynucleotide sequence of SEQ ID NO: 1, SEQ ID NO:2, and SEQ ID NO: 3.

In some embodiments, the method comprises administering two or more of the bacteriophages. In some embodiments, the method comprises the administration of three of the bacteriophages.

In some embodiments, the method may further comprise administering one or more bacteriophages comprising a polynucleotide sequence having at least 90% identity to SEQ ID NO:4 and SEQ ID NO:6.

In some embodiments, the method may further comprise administering a bacteriophage comprising a polynucleotide sequence having at least 90% identity to SEQ ID NO:4 and a bacteriophage comprising a polynucleotide sequence having at least 90% identity to SEQ ID NO:6.

In some embodiments, the bacteriophages comprise a polynucleotide sequence of SEQ ID NO:4 and/or SEQ ID NO:6.

In yet another aspect, the present disclosure provides a method of treating a bacterial infection in a subject with pneumonia comprising administering to the subject one of more distinct bacteriophages selected from a bacteriophage comprising a polynucleotide sequence having at least 90% identity to SEQ ID NO:1 and SEQ ID NO: 3.

In some embodiments, the one or more bacteriophages comprise a polynucleotide sequence of SEQ ID NO:1 and SEQ ID NO: 3.

In some embodiments, the method may comprise two bacteriophages.

In some embodiments, the method may further comprise at least one bacteriophage comprising a polynucleotide sequence having at least 90% sequence identity to SEQ ID NO: 5 or SEQ ID NO: 8.

In some embodiments, the method may further comprise a bacteriophage comprising a polynucleotide sequence having at least 90% sequence identity to SEQ ID NO: 5 and a bacteriophage comprising a polynucleotide sequence having at least 90% sequence identity to SEQ ID NO: 8.

In some embodiments, the method may further comprise bacteriophages having 100% sequence identity to the polynucleotide sequence.

In some embodiments, the method may further comprise a bacteriophage comprising a polynucleotide sequence having at least 90% identity to SEQ ID NO: 12.

In some embodiments, the method may comprise a bacteriophage comprising a polynucleotide sequence of SEQ ID NO: 12.

BRIEF DESCRIPTION OF THE DRAWINGS

Embodiments will now be described, by way of example only, with reference to the accompanying drawings, in which:

FIGS. 1A-D are graphs showing antimicrobial activity of various phage in liquid culture. The killing potential on a subset of *P. aeruginosa* strains, at MOIs 100-0.0001 was assessed for individual phage (FIGS. 1A-C) and as a cocktail (FIG. 1D). The plots depict *Pseudomonas aeruginosa* (PA) strain DCF16. These data suggest that the components of the cocktail have high killing capacity and can work together for increased antimicrobial activity.

FIG. 2A is data showing that growth of the clinical isolate DCF16 is inhibited with a MOI of 0.001 of the cocktail. FIG. 2B is data showing the cocktail inhibits re-growth of clinical isolate 9128.

FIGS. 9A and 9B are the same experiment conducted on different days.

FIG. 10A are results from the cocktail phage components diluted in fresh plasma and the activity of phage was monitored for 90 minutes at 37° C. Graph depicts representative data from 1 donor. FIG. 10B are results from the cocktail phage components incubated with sputum from CF patients for 3 or 24 hours at 37° C. Here, PFU is plaque forming units.

DETAILED DESCRIPTION

Figures 2A, 2B:
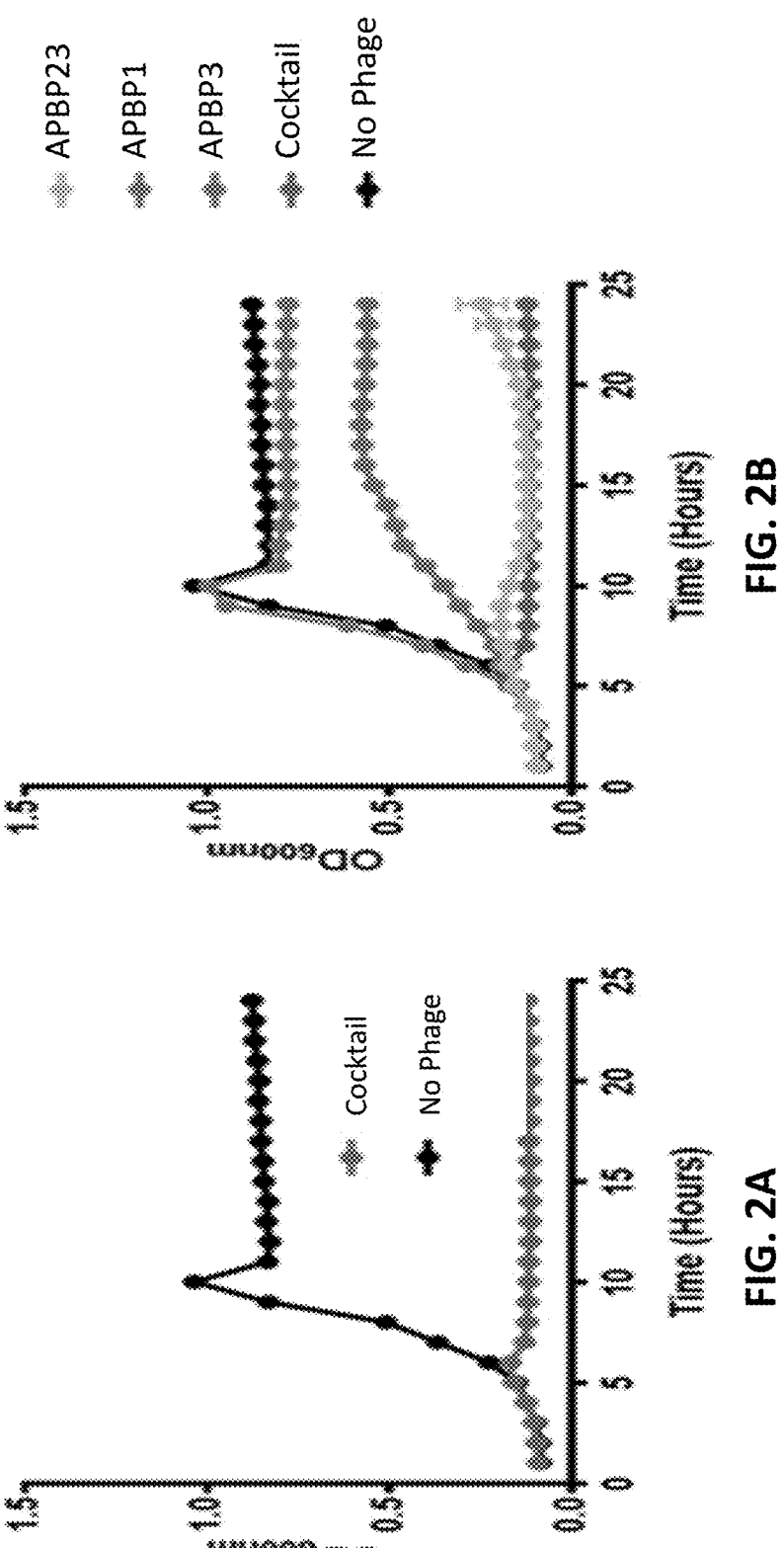
FIGS. 2A-B are graphs showing killing of clinical *P. aeruginosa* isolates, in liquid culture, by the bacteriophage cocktail.

As noted above, there is an antibiotic crisis in the world. Bacterial illness is an everpresent concern, while increasing antibiotic resistance means the number of available and effective antibiotics continues to shrink. The embodiments and aspects of this application provide exciting alternative solutions to the use of standard antibiotics. These embodiments and inventions are the result of significant, non-trivial inventive effort, and the solving of technical challenges and hurdles.

As a result, embodiments and aspects described herein generally relate to novel and inventive bacteriophages, for example, effective for treating *Pseudomonas* infections, alone or in combinations. Described are methods of treating *Pseudomonas* bacterial infections generally, but also certain types of infections, for example, respiratory infections, infections associated with fibrosis, pneumonia, etc. Storage and manufacturing compositions and methods are described. The various embodiments and aspects present exciting and critically needed solutions for the antibiotic crisis across the world.

It is to be understood that the present disclosure is not limited to particular embodiments described, as such may, of course, vary. It is also to be understood that the terminology used herein is for the purpose of describing particular embodiments only, and is not intended to be limiting, since the scope of the present disclosure will be limited only by the appended claims.

The detailed description of the present disclosure is divided into various sections only for the reader's convenience and disclosure found in any section may be combined with that in another section. Unless defined otherwise, all technical and scientific terms used herein have the same meaning as commonly understood by one of ordinary skill in the art to which the present disclosure belongs.

Definitions

It must be noted that as used herein and in the appended claims, the singular forms "a," "an," and "the" include plural referents unless the context clearly dictates otherwise. Thus, for example, reference to "a bacteriophage composition" includes a plurality of such candidate agents and reference to "the bacteriophage" includes reference to one or more bacteriophages and equivalents thereof known to those skilled in the art, and so forth.

In this disclosure, "comprises," "comprising," "containing" and "having" and the like can have the meaning ascribed to them in U.S. Patent law and can mean "includes," "including," and the like. "Consisting essentially of" or "consists essentially" likewise has the meaning ascribed in U.S. Patent law and the term is open-ended, allowing for the presence of more than that which is recited so long as basic or novel characteristics of that which is recited is not changed by the presence of more than that which is recited, but excludes prior art embodiments. "Consisting of" shall mean excluding more than trace elements of other ingredients and substantial method steps. Embodiments defined by each of these transition terms are within the scope of this disclosure.

The term "consists essentially of" as used herein means that only the bacteriophage(s) explicitly indicated are present in the bacteriophage composition, but that said composition may also contain a further non-bacteriophage constituent, such as a pharmaceutically appropriate carrier, diluent, excipient, antibiotic (e.g., chemical antibiotic), etc., or combinations thereof. As used herein, the term "about" when used before a numerical designation, e.g., temperature, time, amount, concentration, and such other, including a range, indicates approximations which may vary by (+) or (−) 10%, 5%, or 1%. All values in this disclosure are preceded by the term "about," even if not explicitly recited.

When a range (e.g., dosage range) is listed herein, it is to be understood that the value may include any individual value or range within the recited range(s), including endpoints.

As used herein, the terms "mutant" and "variant" are used interchangeably, and refer to a bacteriophage differing genetically from a reference bacteriophage, but that still retains the ability to infect and kill *Pseudomonas aeruginosa* target bacteria. For example, "mutant" can refer to a bacteriophage that has mutated genetically compared to one or more of SEQ ID NO:4, SEQ ID NO:1, SEQ ID NO:2, SEQ ID NO:5, SEQ ID NO:6, SEQ ID NO:3 and/or any of the other bacteriophage referenced or described herein, but that still retains the ability to infect and kill *Pseudomonas aeruginosa* target bacteria. Mutants can comprise e.g., silent mutations, conservative mutations, minor deletions, and/or minor replications of genetic material, and retain phenotypic characteristics of the reference bacteriophage. In embodiments, a "mutant" may be a bacteriophage progeny. A bacteriophage progeny may be a bacteriophage obtainable after lysing *Pseudomonas* (e.g., *P. aeruginosa*) target bacteria using a bacteriophage as described herein (i.e., the "parent bacteriophage"). In other words, the bacteriophage progeny may be a second (or further) generation bacteriophage. In an embodiment, the mutants retain any observable characteristic or property that is dependent upon the genome of the bacteriophage as described herein, i.e. phenotypic characteristics of said bacteriophage and/or lytic activity against *Pseudomonas* species or strains. Preferred mutants retain the ability to infect and kill *Pseudomonas aeruginosa* target bacteria and have less than 10% nucleic acid variation as compared to the genome of the reference bacteriophage, even more preferably less than 7%, more preferably less than 1%. Alternatively, or in combination, mutants have preferably less than 7% amino acid variation in a coded polypeptide sequence as compared to a polypeptide of the reference bacteriophage.

As used herein, the terms "% identity," "% sequence identity" and "percent identity" in relation to nucleic acid or amino acid sequences designates the level of identity or homology between said sequences and may be determined by techniques known in the art. Any of a variety of sequence alignment methods can be used to determine percent identity, including, without limitation, global methods, local methods and hybrid methods, such as segment approach methods. Protocols to determine percent identity are routine procedures within the scope of one skilled in the art. Global methods align sequences from the beginning to the end of the molecule and determine the best alignment by adding up scores of individual nucleotide pairs and by imposing gap penalties. Non-limiting methods include, e.g., CLUSTAL W, see, e.g., Julie D. Thompson et al., CLUSTAL W: Improving the Sensitivity of Progressive Multiple Sequence Alignment Through Sequence Weighting, Position-Specific Gap Penalties and Weight Matrix Choice, 22(22) Nucleic Acids Research 4673-4680 (1994); and iterative refinement. Non-limiting methods include, e.g., BLAST, Match-box, see, e.g., Align-M, see, e.g., Ivo Van Walle et al., Align-M—A New Algorithm for Multiple Alignment of Highly Divergent Sequences, Bioinformatics 20(9):1428-1435 (2004). This definition also refers to, or may be applied to, the complement of a test sequence. The definition also includes sequences that have deletions and/or additions, as well as those that have substitutions. As described below, the preferred algorithms can account for gaps and the like. Preferably, identity exists over a region that is at least about 100 nucleotides in length, or more preferably over a region that is 100-1000 or more nucleotides in length.

As used herein, the term "bacterial complementation" refers to the ability of a bacteriophage with a particular genome to compensate for a different, distinct bacteriophage with a different genome. More specifically, bacteriophage insensitive mutant colonies (of target bacteria) may arise to a particular bacteriophage but may still be sensitive to a different bacteriophage. In other words, bacteriophage resistant mutant bacteria arising to one phage are still sensitive to another phage.

As used herein, the terms "treating" or "treatment" (and as well understood in the art) are used in accordance with their plain and ordinary meaning and broadly includes any approach for obtaining beneficial or desired results in a subject's condition, including clinical results. Beneficial or desired clinical results can include, but are not limited to, alleviation or amelioration of one or more symptoms or conditions, diminishment of the extent of a disease, stabilizing (i.e., not worsening) the state of disease, prevention of a disease's transmission or spread, delay or slowing of disease progression, amelioration or palliation of the disease state, diminishment of the reoccurrence of disease, and remission, whether partial or total and whether detectable or undetectable. In other words, "treatment" as used herein includes any cure, amelioration, or prevention of a disease. Treatment may prevent the disease from occurring; inhibit the disease's spread; relieve the disease's symptoms, fully or partially remove the disease's underlying cause, shorten a disease's duration, or do a combination of these things. As used herein, the term "treat" or "treating" is intended to encompass prophylactic treatment as well as corrective treatment (treatment of a subject already suffering from a disease).

As used herein, the term "administering" means oral, intravenous, parenteral, intraperitoneal, intramuscular, intrathecal, intranasal, pulmonary, or subcutaneous administration for example, or the implantation of a slow-release device, e.g., a mini-osmotic pump, to a subject. Administration is by any route, including parenteral and transmucosal (e.g., buccal, sublingual, palatal, gingival, nasal, vaginal, rectal, or transdermal). Parenteral administration includes, e.g., intravenous, intramuscular, intra-arteriole, intradermal, subcutaneous, intraperitoneal, intraventricular, and intracranial. Other modes of delivery include, but are not limited to, the use of liposomal formulations, intravenous infusion, transdermal patches, and the like. In embodiments, the administering does not include administration of any active agent other than the recited active agent. In embodiments, administration of compositions described herein is by intravenous administration. In embodiments, administration of compositions described herein is by intranasal administration such as inhalation or nebulization. In embodiments, administration may be pulmonary delivery via nasal or oral administration (e.g. by aerosolization or nebulization).

"Co-administer" it is meant that a composition described herein is administered at the same time, just prior to, or just after the administration of one or more additional therapies. The compounds provided herein can be administered alone or can be co-administered to the patient. Co-administration is meant to include simultaneous or sequential administration of the compounds individually or in combination (more than one compound). Thus, the preparations can also be combined, when desired, with other active substances (e.g. antibiotic).

As used herein, the term "lytic" or "lytic activity" designates the property of a bacteriophage to cause lysis of a bacterial cell. The lytic activity of a bacteriophage can be tested on a bacteria (e.g., *P. aeruginosa* strains) according to techniques known in the art. The lytic cycle is named for the process that occurs when a phage has infected a cell, replicated new phage particles, and bursts through the host cell membrane. Some phage exhibit a lysogenic cycle during which the bacteriophage DNA remains practically dormant due to active repression of bacteriophage processes. Whenever the bacteria divides, the DNA of the phage is copied as well. In this way, the virus can continue replicating within its host without lysing the host. At a certain point, conditions may change and the phage enters a lytic cycle. "Obligately lytic" refers to phage that are unable to undergo a lysogenic cycle.

As used herein, the term "bacteriophage target" refers to any bacteria species that can be infected by a particular bacteriophage. A bacteriophage recognizes the target bacterial cell surface, binds, and injects its genetic material inside the bacterial host. The genetic material from the infecting phage can be incorporated into the bacterial genome. The bacteriophage may become lysogenic, where the viral genome remains dormant in the bacterial host genome until a triggering event. The bacteriophage may also become lytic, wherein many copies of the infecting phage are produced by the machinery of the infected bacteria, and the copies are subsequently released by bacterial lysis, extrusion, or by budding. In embodiments, the bacterial target is *Pseudomonas aeruginosa*.

As used herein, the term "bacterial host manufacturing strain" or "manufacturing strain" refers to the bacteria used to grow bacteriophage. A method for bacteriophage production may require a production process involving at least two operating units, growth of the host bacteria and bacteriophage propagation (or infection). It is important to consider basic parameters for bacterial growth and phage infection, such as the selected substrates for the bacterium and the optimal temperature, both for bacterial growth and phage infection, since these factors may influence the infectivity of phages.

As used herein, the term "Myoviridae" refers to a virus that belongs to Regum: virus, Group 1: dsDNA, Ordo: Caudovirales, Familia: Myoviridae. Genera include Pbunavirus and Pakpunavirus. In embodiments, Myoviridae include phage belonging to the Genus Pbunavirus (SEQ ID NO:1, SEQ ID NO:2, SEQ ID NO:18, SEQ ID NO:19, SEQ ID NO:20, SEQ ID NO:21). In embodiments, Myoviridae include phage belonging to the Genus Pakpunavirus (SEQ ID NO:4, SEQ ID NO:8, SEQ ID NO:9, SEQ ID NO:10). In embodiments, Myoviridae include species belonging to the Genus Nankokuvirus (SEQ ID NO:14, SEQ ID NO:15).

As used herein, the term "Podoviridae" refers to a virus that belongs to Regum: virus, Group 1: dsDNA, Ordo: Caudovirales, Familia: Podoviridae. Genera include Bruynoghevirus, Phikmvvirus, Luzseptimavirus, and Litunavirus. In embodiments, Podoviridae include phage belonging to the Genus Bruynoghevirus (SEQ ID NO:6, SEQ ID NO:11, SEQ ID NO:12, SEQ ID NO:13). In embodiments, Podoviridae include phage belonging to the Genus Phikmvvirus (SEQ ID NO:3, SEQ ID NO:16, SEQ ID NO:17). In embodiments, Podoviridae include phage belonging to the Genus Luzseptimavirus (SEQ ID NO:5). In embodiments, Podoviridae include phage belonging to the Genus Litunavirus (SEQ ID NO:7, SEQ ID NO:22). In embodiments, Podoviridae include species belonging to the Genus Bruynoghevirus. In embodiments, Podoviridae include species belonging to the Genus Phikmvvirus. In embodiments, Podoviridae include species belonging to the Genus Luzseptimavirus. In embodiments, Podoviridae include species belonging to the Genus Litunavirus.

As used herein, the term "sputum" refers to matter expectorated from the respiratory system. Sputum can be composed of mucus, pus, blood, microorganisms, saliva, and foreign material.

A use or method typically comprises administering a bacteriophage or bacteriophage composition described herein to a subject. As used herein, a "subject" is a mammal, such as a human or other animal. Preferably, the subject is a human.

As used herein, the term "isolated" indicates that the bacteriophage are removed from its original environment in which it naturally occurs. In particular, an isolated bacteriophage is, e.g., cultivated, cultured separately from the environment in which it is naturally located.

As used herein, the term "purified" indicates that the bacteriophages are removed from nature and/or a manufacturing host bacteria. In particular, a purified bacteriophage has production impurities, such as bacterial components, substantially removed from its manufacturing or production environment. Bacterial components include but are not limited to bacterial host proteins, lipids, and/or bacterial endotoxin. The term "purified" may also refer to genetic purification in which the strain of bacteriophage is genetically homogenous. In some embodiments, the purified bacteriophage comprises a bacteriophage that is at least 99% pure, or at least 99% of the desired population of bacteriophages.

As used herein, the term "substantially purified" refers to a composition containing less than 1%, less than 0.1%, less than 0.001%, or no detectable amount of contaminants such as host bacterial proteins or endotoxin. Also, as used herein, the term "substantially pure" when used to describe a bacteriophage strain refers to the genetic purity of the composition such that the strain is greater than 99%, greater than 99.9%, greater than 99.999%, or 100% of one particular genome sequence.

Typically, a composition is substantially pure when at least 80%, at least 85%, at least 90%, at least 95%, at least 98%, or at least 99% (or any sub value or subrange therebetween) of the total material (by volume, by wet or dry weight, or by mole percent or mole fraction) in a sample is free of impurities or genetic variants.

As used herein, the term "subject" or "patient" refers to a human or non-human animal. Preferably, the subject or patient is in need of treatment with the composition as described herein, e.g., has a bacterial infection susceptible to treatment with the composition.

As used herein, the "synergistic amount" refers to the sum of a first amount (e.g., a bacteriophage) and a second amount (e.g., a different bacteriophage) that results in a synergistic effect (i.e. an effect greater than an additive effect). Therefore, the terms "synergy", "synergism", "synergistic", "combined synergistic amount", and "synergistic therapeutic effect" which are used herein interchangeably, refer to a measured effect of the compound administered in combination where the measured effect is greater than the sum of the individual effects of each of the compounds provided herein administered alone as a single agent.

As used herein, the term "substantially free" refers to something having less than 10% of the substance that it is to be free from. For example, 0.01% to 10% free of the substance, including any subvalue and subrange therein, including endpoints. For example, 0.01, 0.02, 0.03, 0.04, 0.05, 0.06, 0.07, 0.08, 0.09, 1, 2, 3, 4, 5, 6, 7, 8, 9, or 10% (or any sub value or subrange therebetween, inclusive of endpoints).

As used herein, the term "obtainable" as used herein also encompasses the term "obtained." In one embodiment, the term "obtainable" means obtained.

As used herein, the terms "pharmaceutically acceptable excipient" and "pharmaceutically acceptable carrier" refer to a substance that aids the administration of an active agent to and absorption by a subject and can be included in the compositions of the present disclosure without causing a significant adverse toxicological effect on the patient. Non-limiting examples of pharmaceutically acceptable excipients include water, NaCl, normal saline solutions, lactated Ringer's, normal sucrose, normal glucose, binders, fillers, disintegrants, lubricants, coatings, sweeteners, flavors, salt solutions (such as Ringer's solution), alcohols, oils, gelatins, carbohydrates such as lactose, amylose or starch, fatty acid esters, hydroxymethycellulose, polyvinyl pyrrolidine, and colors, and the like. Such preparations can be sterilized and, if desired, mixed with auxiliary agents such as lubricants, preservatives, stabilizers, wetting agents, emulsifiers, salts for influencing osmotic pressure, buffers, coloring, and/or aromatic substances and the like that do not deleteriously react with the compounds of the disclosure. One of skill in the art will recognize that other pharmaceutical excipients are useful in the present disclosure.

As used herein, the term "pharmaceutically acceptable salts" is meant to include salts of the active compounds that are prepared with relatively nontoxic acids or bases, depending on the particular substituents found on the compounds described herein. When compounds of the present disclosure contain relatively acidic functionalities, base addition salts can be obtained by contacting the neutral form of such compounds with a sufficient amount of the desired base, either neat or in a suitable inert solvent. Examples of pharmaceutically acceptable base addition salts include sodium, potassium, calcium, ammonium, organic amino, or magnesium salt, or a similar salt. When compounds of the present disclosure contain relatively basic functionalities, acid addition salts can be obtained by contacting the neutral form of such compounds with a sufficient amount of the desired acid, either neat or in a suitable inert solvent. Examples of pharmaceutically acceptable acid addition salts include those derived from inorganic acids like hydrochloric, hydrobromic, nitric, carbonic, monohydrogencarbonic, phosphoric, monohydrogenphosphoric, dihydrogenphosphoric, sulfuric, monohydrogensulfuric, hydriodic, or phosphorous acids and the like, as well as the salts derived from relatively nontoxic organic acids like acetic, propionic, isobutyric, maleic, malonic, benzoic, succinic, suberic, fumaric, lactic, mandelic, phthalic, benzenesulfonic, p-tolylsulfonic, citric, tartaric, oxalic, methanesulfonic, and the like. Also included are salts of amino acids such as arginate and the like, and salts of organic acids like glucuronic or galactunoric acids and the like.

As used herein, the term "persist" refers to the ability to remain present or continue to exist past a usual, expected, or normal time.

As used herein, "broadened" or "broader" in the context of bacteriophage target range refers to increased host range. Host range is the number of cell types, strains, or host species a virus/bacteriophage (or combination of viruses) is able to infect. Increase of host range or target bacteria range is an expansion of the absolute number of distinct cell types, strains, or species a virus (or combination of viruses) is able to infect compared to a reference and/or non-engineered virus. In some examples, increased host range or increased target bacteria range is an increase in the number of bacterial strains or variants within a bacterial species that the virus (or combination of viruses) is able to infect. The increase in host range can be an increase of at least one or more than one strain, cell type, or species. Host range can be assayed, for example, by a standard plaque assay that is well known in the art.

As used herein, "multiplicity of infection (MOI)" is the ratio of the numbers of virus particles to the numbers of the host cells in a given infection medium. A value of MOI=1 implies that on an average there is a single host cell for a single phage particle.

As used herein, "partially synthetic" phage refers to a phage for which a limited, fractional, or substantial portion of the genome has been designed or engineered. As used herein, "fully synthetic" phage refers to a phage for which the entire genome has been designed or engineered.

Additional terms and phrases are defined below.

Bacteriophage Compositions

Embodiments relate to bacteriophages and compositions of one or more bacteriophages. The bacteriophage and/or compositions of bacteriophages can be or include isolated and/or purified bacteriophage. Some embodiments relate to combinations of multiple different individual bacteriophages or multiple groups of bacteriophage populations, including some or all that are isolated and/or purified. The bacteriophage can include a nucleic acid sequence that has sequence identity to at least one of the polynucleotide sequences set forth or described herein. In some aspects, provided herein are bacteriophages and/or compositions comprising polynucleotide sequences having sequence identity to one or more of SEQ ID NOs: 1-22. For example, the bacteriophage can have between 60% to 100% sequence identity, including any sub value (e.g., 61%, 62%, 63% . . . 80%, 81%, 82%, 83%, 84%, 85%, 86%, . . . 96%, 97%, 98%, 99%, 99.9%, etc.) or subrange (e.g., 80%-100%, 93%-99.9%, etc.) therein, including endpoints.

In an aspect, provided herein is an isolated, purified bacteriophage that includes a polynucleotide sequence of SEQ ID NO: 1. In an aspect, provided herein is an isolated, purified bacteriophage that includes a polynucleotide sequence with at least 90% identity to SEQ ID NO: 1. In embodiments, the isolated, purified bacteriophage includes a polynucleotide sequence with at least 90% identity to SEQ ID NO: 1 and is a Myoviridae Pbunavirus bacteriophage. In embodiments, the isolated, purified bacteriophage is designated APBP1 and includes a polynucleotide sequence as in SEQ ID NO: 1.

In embodiments, the bacteriophage composition includes a bacteriophage that includes a polynucleotide sequence with at least 80% to 99.9% identity to SEQ ID NO: 1, or any sub value or subrange there between, inclusive of endpoints. For example, in embodiments, the bacteriophage composition includes a bacteriophage that includes a polynucleotide sequence with at least 99.9%, 99.8%, 99.7%, 99.6%, 99.5%, 99.4%, 99.3%, 99.2%, 99.1%, 99.0%, or 99% identity to SEQ ID NO: 1. In embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 1. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 1. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 1. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 1. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 1. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 1. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 1. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 91% identity to SEQ ID NO: 1. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 1. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 1. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 1. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 1. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 1. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 1. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 1. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 1. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 1. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 1. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 1. In embodiments, the bacteriophage genome comprises the polynucleotide sequence of SEQ ID NO: 1.

In an aspect, provided herein is an isolated, purified bacteriophage that includes a polynucleotide sequence identified as SEQ ID NO: 2. In an aspect, provided herein is an isolated, purified bacteriophage that includes a polynucleotide sequence with at least 90% identity to SEQ ID NO: 2. In embodiments, the isolated, purified bacteriophage includes a polynucleotide sequence with at least 90% identity to SEQ ID NO: 2 and is a Myoviridae Pbunavirus bacteriophage. In embodiments, the isolated, purified bacteriophage is designated APBP2 and includes a polynucleotide sequence as in SEQ ID NO: 2.

In embodiments, the bacteriophage composition includes a bacteriophage that includes a polynucleotide sequence with at least 80% to 99.9% identity to SEQ ID NO: 2, or any sub value or subrange there between, inclusive of endpoints. For example, in embodiments, the bacteriophage composition includes a bacteriophage that includes a polynucleotide sequence with at least 99.9%, 99.8%, 99.7%, 99.6%, 99.5%, 99.4%, 99.3%, 99.2%, 99.1%, 99.0%, or 99% identity to SEQ ID NO: 2. In embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 2. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 2. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 2. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 2. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 2. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 2. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 2. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 91% identity to SEQ ID NO: 2. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 2. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 2. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 2. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 2. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 2. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 2. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 2. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 2. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 2. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 2. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 2. In embodiments, the bacteriophage genome comprises the polynucleotide sequence of SEQ ID NO: 2.

In an aspect, provided herein is an isolated, purified bacteriophage that includes a polynucleotide sequence identified as SEQ ID NO: 3. In embodiments, the isolated, purified bacteriophage includes a polynucleotide sequence with at least 90% identity to SEQ ID NO: 3 and is a Podoviridae Phikmvvirus bacteriophage. In embodiments, the isolated, purified bacteriophage is designated APBP3 and includes a polynucleotide sequence as in SEQ ID NO: 3. In an aspect, provided herein is an isolated, purified bacteriophage that includes a polynucleotide sequence with at least 90% identity to SEQ ID NO: 3.

In embodiments, the bacteriophage composition includes a bacteriophage that includes a polynucleotide sequence with at least 80% to 99.9% identity to SEQ ID NO: 3, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 3. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 3. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 3. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 3. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 3. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 3. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 3. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 910% identity to SEQ ID NO: 3. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 3. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 3. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 3. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 3. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 3. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 3. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 3. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 3. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 3. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 3. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 3. In embodiments, the bacteriophage genome comprises the polynucleotide sequence of SEQ ID NO: 3.

In an aspect, provided herein is an isolated, purified bacteriophage that includes a polynucleotide sequence identified as SEQ ID NO: 4. In embodiments, the isolated, purified bacteriophage includes a polynucleotide sequence with at least 90% identity to SEQ ID NO: 4 and is a Myoviridae Pakpunavirus bacteriophage. In embodiments, the isolated, purified bacteriophage is designated APBP4 and includes a polynucleotide sequence as in SEQ ID NO: 4. In an aspect, provided herein is an isolated, purified bacteriophage that includes a polynucleotide sequence with at least 90% identity to SEQ ID NO: 4.

In embodiments, the bacteriophage composition includes a bacteriophage that includes a polynucleotide sequence with at least 80% to 99.9% identity to SEQ ID NO: 4, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 4. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 4. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 4. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 4. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 4. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 4. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 4. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 910% identity to SEQ ID NO: 4. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 4. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 4. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 4. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 4. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 4. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 4. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 4. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 4. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 4. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 4. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 4. In embodiments, the bacteriophage genome comprises the polynucleotide sequence of SEQ ID NO: 4.

In an aspect, provided herein is an isolated, purified bacteriophage that includes a polynucleotide sequence identified as SEQ ID NO: 5. In embodiments, the isolated, purified bacteriophage includes a polynucleotide sequence with at least 90% identity to SEQ ID NO: 5 and is a Podoviridae Luzseptimavirus bacteriophage. In embodiments, the isolated, purified bacteriophage is designated APBP5 and includes a polynucleotide sequence as in SEQ ID NO: 5. In an aspect, provided herein is an isolated, purified bacteriophage that includes a polynucleotide sequence with at least 90% identity to SEQ ID NO: 5.

In embodiments, the bacteriophage composition includes a bacteriophage that includes a polynucleotide sequence with at least 80% to 99.9% identity to SEQ ID NO: 5, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 5. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 5. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 5. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 5. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 5. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 5. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 5. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 910% identity to SEQ ID NO: 5. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 5. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 5. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 5. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 5. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 5. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 5. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 5. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 5. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 5. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 5. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 5. In embodiments, the bacteriophage genome comprises the polynucleotide sequence of SEQ ID NO: 5.

In an aspect, provided herein is an isolated, purified bacteriophage that includes a polynucleotide sequence identified as SEQ ID NO: 6. In embodiments, the isolated, purified bacteriophage includes a polynucleotide sequence with at least 90% identity to SEQ ID NO: 6 and is a Podoviridae Bruynoghevirus bacteriophage. In embodiments, the isolated, purified bacteriophage is designated APBP6 and includes a polynucleotide sequence as in SEQ ID NO: 6. In an aspect, provided herein is an isolated, purified bacteriophage that includes a polynucleotide sequence with at least 90% identity to SEQ ID NO: 6.

In embodiments, the bacteriophage composition includes a bacteriophage that includes a polynucleotide sequence with at least 80% to 99.9% identity to SEQ ID NO: 6, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 6. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 6. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 6. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 6. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 6. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 6. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 6. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 910% identity to SEQ ID NO: 6. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 6. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 6. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 6. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 6. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 6. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 6. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 6. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 6. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 6. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 6. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 6. In embodiments, the bacteriophage genome comprises the polynucleotide sequence of SEQ ID NO: 6.

In an aspect, provided herein is an isolated, purified bacteriophage that includes a polynucleotide sequence identified as SEQ ID NO: 7. In embodiments, the isolated, purified bacteriophage includes a polynucleotide sequence with at least 90% identity to SEQ ID NO: 7 and is a Podoviridae Litunavirus bacteriophage. In embodiments, the isolated, purified bacteriophage is designated APBP7 and includes a polynucleotide sequence as in SEQ ID NO: 7. In an aspect, provided herein is an isolated, purified bacteriophage that includes a polynucleotide sequence with at least 90% identity to SEQ ID NO: 7.

In embodiments, the bacteriophage composition includes a bacteriophage that includes a polynucleotide sequence with at least 80% to 99.9% identity to SEQ ID NO: 7, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 7. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 7. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 7. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 7. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 7. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 7. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 7. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 910% identity to SEQ ID NO: 7. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 7. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO:7. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 7. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 6. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 7. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 7. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 7. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 7. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 7. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 7. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 7. In embodiments, the bacteriophage genome comprises the polynucleotide sequence of SEQ ID NO: 7.

In an aspect, provided herein is an isolated, purified bacteriophage that includes a polynucleotide sequence identified as SEQ ID NO: 8. In embodiments, the isolated, purified bacteriophage includes a polynucleotide sequence with at least 90% identity to SEQ ID NO: 8 and is a Myoviridae Pakpunavirus bacteriophage. In embodiments, the isolated, purified bacteriophage is designated APBP8 and includes a polynucleotide sequence as in SEQ ID NO: 8. In an aspect, provided herein is an isolated, purified bacteriophage that includes a polynucleotide sequence with at least 90% identity to SEQ ID NO: 8.

In embodiments, the bacteriophage composition includes a bacteriophage that includes a polynucleotide sequence with at least 80% to 99.9% identity to SEQ ID NO: 8, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 8. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 8. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 8. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 8. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 8. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 8. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 8. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 910% identity to SEQ ID NO: 8. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 8. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 8. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 8. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 8. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 8. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 8. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 8. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 8. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 8. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 810% identity to SEQ ID NO: 8. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 8. In embodiments, the bacteriophage genome comprises the polynucleotide sequence of SEQ ID NO: 8.

In an aspect, provided herein is an isolated, purified bacteriophage that includes a polynucleotide sequence identified as SEQ ID NO: 9. In embodiments, the isolated, purified bacteriophage includes a polynucleotide sequence with at least 90% identity to SEQ ID NO: 9 and is a Myoviridae Pakpunavirus bacteriophage. In embodiments, the isolated, purified bacteriophage is designated APBP9 and includes a polynucleotide sequence as in SEQ ID NO: 9. In an aspect, provided herein is an isolated, purified bacteriophage that includes a polynucleotide sequence with at least 90% identity to SEQ ID NO: 9.

In embodiments, the bacteriophage composition includes a bacteriophage that includes a polynucleotide sequence with at least 80% to 99.9% identity to SEQ ID NO: 9, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 9. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 9. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 9. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 9. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 9. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 9. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 9. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 910% identity to SEQ ID NO: 9. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 9. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 9. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 9. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 9. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 9. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 9. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 9. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 9. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 9. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 9. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 9. In embodiments, the bacteriophage genome comprises the polynucleotide sequence of SEQ ID NO: 9.

In an aspect, provided herein is an isolated, purified bacteriophage that includes a polynucleotide sequence identified as SEQ ID NO: 10. In embodiments, the isolated, purified bacteriophage includes a polynucleotide sequence with at least 90% identity to SEQ ID NO: 10 and is a Myoviridae Pakpunavirus bacteriophage. In embodiments, the isolated, purified bacteriophage is designated APBP10 and includes a polynucleotide sequence as in SEQ ID NO: 10. In an aspect, provided herein is an isolated, purified bacteriophage that includes a polynucleotide sequence with at least 90% identity to SEQ ID NO: 10.

In embodiments, the bacteriophage composition includes a bacteriophage that includes a polynucleotide sequence with at least 80% to 99.9% identity to SEQ ID NO: 10, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 10. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 10. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 10. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 10. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 10. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 10. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 10. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 91% identity to SEQ ID NO: 10. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 10. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 10. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 10. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 10. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 10. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 10. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 10. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 10. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 10. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 10. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 10. In embodiments, the bacteriophage genome comprises the polynucleotide sequence of SEQ ID NO: 10.

In an aspect, provided herein is an isolated, purified bacteriophage that includes a polynucleotide sequence identified as SEQ ID NO: 11. In embodiments, the isolated, purified bacteriophage includes a polynucleotide sequence with at least 90% identity to SEQ ID NO: 11 and is a Podoviridae Bruynoghevirus bacteriophage. In embodiments, the isolated, purified bacteriophage is designated APBP11 and includes a polynucleotide sequence as in SEQ ID NO: 11. In an aspect, provided herein is an isolated, purified bacteriophage that includes a polynucleotide sequence with at least 90% identity to SEQ ID NO: 11.

In embodiments, the bacteriophage composition includes a bacteriophage that includes a polynucleotide sequence with at least 80% to 99.9% identity to SEQ ID NO: 11, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 11. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 11. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 11. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 11. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 11. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 11. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 11. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 910% identity to SEQ ID NO: 11. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 11. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 11. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 11. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 11. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 11. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 11. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 11. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 11. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 11. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 11. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 11. In embodiments, the bacteriophage genome comprises the polynucleotide sequence of SEQ ID NO: 11.

In an aspect, provided herein is an isolated, purified bacteriophage that includes a polynucleotide sequence identified as SEQ ID NO: 12. In embodiments, the isolated, purified bacteriophage includes a polynucleotide sequence with at least 90% identity to SEQ ID NO: 12 and is a Podoviridae Bruynoghevirus bacteriophage. In embodiments, the isolated, purified bacteriophage is designated APBP12 and includes a polynucleotide sequence as in SEQ ID NO:12. In an aspect, provided herein is an isolated, purified bacteriophage that includes a polynucleotide sequence with at least 90% identity to SEQ ID NO: 12.

In embodiments, the bacteriophage composition includes a bacteriophage that includes a polynucleotide sequence with at least 80% to 99.9% identity to SEQ ID NO: 12, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 12. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 12. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 12. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 12. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 12. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 12. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 12. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 91% identity to SEQ ID NO: 12. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 12. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 12. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 12. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 12. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 12. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 12. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 12. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 12. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 12. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 12. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 12. In embodiments, the bacteriophage genome comprises the polynucleotide sequence of SEQ ID NO: 12.

In an aspect, provided herein is an isolated, purified bacteriophage that includes a polynucleotide sequence identified as SEQ ID NO: 13. In embodiments, the isolated, purified bacteriophage includes a polynucleotide sequence with at least 90% identity to SEQ ID NO: 13 and is a Podoviridae Bruynoghevirus bacteriophage. In embodiments, the isolated, purified bacteriophage is designated APBP13 and includes a polynucleotide sequence as in SEQ ID NO: 13. In an aspect, provided herein is an isolated, purified bacteriophage that includes a polynucleotide sequence with at least 90% identity to SEQ ID NO: 13.

In embodiments, the bacteriophage composition includes a bacteriophage that includes a polynucleotide sequence with at least 80% to 99.9% identity to SEQ ID NO: 13, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 13. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 13. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 13. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 13. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 13. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 13. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 13. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 91% identity to SEQ ID NO: 13. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 13. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 13. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 13. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 13. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 13. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 13. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 13. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 13. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 13. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 13. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 13. In embodiments, the bacteriophage genome comprises the polynucleotide sequence of SEQ ID NO: 13.

In an aspect, provided herein is an isolated, purified bacteriophage that includes a polynucleotide sequence identified as SEQ ID NO: 14. In embodiments, the isolated, purified bacteriophage includes a polynucleotide sequence with at least 90% identity to SEQ ID NO: 14 and is a Myoviridae Nankokuvirus bacteriophage. In embodiments, the isolated, purified bacteriophage is designated APBP14 and includes a polynucleotide sequence as in SEQ ID NO: 14. In an aspect, provided herein is an isolated, purified bacteriophage that includes a polynucleotide sequence with at least 90% identity to SEQ ID NO: 14.

In embodiments, the bacteriophage composition includes a bacteriophage that includes a polynucleotide sequence with at least 80% to 99.9% identity to SEQ ID NO: 14, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 14. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 14. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 14. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 14.

In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 14. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 14. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 14. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 91% identity to SEQ ID NO: 14. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 14. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 14. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 14. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 14. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 14. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 14. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 14. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 14. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 14. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 14. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 14. In embodiments, the bacteriophage genome comprises the polynucleotide sequence of SEQ ID NO: 14.

In an aspect, provided herein is an isolated, purified bacteriophage that includes a polynucleotide sequence identified as SEQ ID NO: 15. In embodiments, the isolated, purified bacteriophage includes a polynucleotide sequence with at least 90% identity to SEQ ID NO: 15 and is a Myoviridae Nankokuvirus bacteriophage. In embodiments, the isolated, purified bacteriophage is designated APBP15 and includes a polynucleotide sequence as in SEQ ID NO: 15. In an aspect, provided herein is an isolated, purified bacteriophage that includes a polynucleotide sequence with at least 90% identity to SEQ ID NO: 15.

In embodiments, the bacteriophage composition includes a bacteriophage that includes a polynucleotide sequence with at least 80% to 99.9% identity to SEQ ID NO: 15, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 15. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 15. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 15. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 15. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 15. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 15. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 15. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 91% identity to SEQ ID NO: 15. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 15. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 15. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 15. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 15. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 15. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 15.

In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 15. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 15. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 15. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 15. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 15. In embodiments, the bacteriophage genome comprises the polynucleotide sequence of SEQ ID NO: 15.

In an aspect, provided herein is an isolated, purified bacteriophage that includes a polynucleotide sequence identified as SEQ ID NO: 16. In embodiments, the isolated, purified bacteriophage includes a polynucleotide sequence with at least 90% identity to SEQ ID NO: 16 and is a Podoviridae Phikmvvirus bacteriophage. In embodiments, the isolated, purified bacteriophage is designated APBP16 and includes a polynucleotide sequence as in SEQ ID NO: 16. In an aspect, provided herein is an isolated, purified bacteriophage that includes a polynucleotide sequence with at least 90% identity to SEQ ID NO: 16.

In embodiments, the bacteriophage composition includes a bacteriophage that includes a polynucleotide sequence with at least 80% to 99.9% identity to SEQ ID NO: 16, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 16. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 16. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 16. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 16. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 16. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 16. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 16. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 91% identity to SEQ ID NO: 16. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 16. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 16. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 16. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 16. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 16. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 16. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 16. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 16. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 16. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 16. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 16. In embodiments, the bacteriophage genome comprises the polynucleotide sequence of SEQ ID NO: 16.

In an aspect, provided herein is an isolated, purified bacteriophage that includes a polynucleotide sequence identified as SEQ ID NO: 17. In embodiments, the isolated, purified bacteriophage includes a polynucleotide sequence with at least 90% identity to SEQ ID NO: 17 and is a Podoviridae Phikmvvirus bacteriophage. In embodiments, the isolated, purified bacteriophage is designated APBP17 and includes a polynucleotide sequence as in SEQ ID NO: 17. In an aspect, provided herein is an isolated, purified bacteriophage that includes a polynucleotide sequence with at least 90% identity to SEQ ID NO: 17.

In embodiments, the bacteriophage composition includes a bacteriophage that includes a polynucleotide sequence with at least 80% to 99.9% identity to SEQ ID NO: 17, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 17. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 17. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 17. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 17. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 17. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 17. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 17. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 91% identity to SEQ ID NO: 17. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 17. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 17. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 17. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 17. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 17. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 17. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 17. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 17. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 17. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 17. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 17. In embodiments, the bacteriophage genome comprises the polynucleotide sequence of SEQ ID NO: 17.

In an aspect, provided herein is an isolated, purified bacteriophage that includes a polynucleotide sequence identified as SEQ ID NO: 18. In embodiments, the isolated, purified bacteriophage includes a polynucleotide sequence with at least 90% identity to SEQ ID NO: 18 and is a Myoviridae Pbunavirus bacteriophage. In embodiments, the isolated, purified bacteriophage is designated APBP18 and includes a polynucleotide sequence as in SEQ ID NO: 18. In an aspect, provided herein is an isolated, purified bacteriophage that includes a polynucleotide sequence with at least 90% identity to SEQ ID NO: 18.

In embodiments, the bacteriophage composition includes a bacteriophage that includes a polynucleotide sequence with at least 80% to 99.9% identity to SEQ ID NO: 18, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 18. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 18. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 18. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 18. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 18. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 18. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 18. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 91% identity to SEQ ID NO: 18. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 18. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 18. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 18. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 18. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 18. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 18. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 18. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 18. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 18. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 18. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 18. In embodiments, the bacteriophage genome comprises the polynucleotide sequence of SEQ ID NO: 18.

In an aspect, provided herein is an isolated, purified bacteriophage that includes a polynucleotide sequence identified as SEQ ID NO: 19. In embodiments, the isolated, purified bacteriophage includes a polynucleotide sequence with at least 90% identity to SEQ ID NO: 19 and is a Myoviridae Pbunavirus bacteriophage. In embodiments, the isolated, purified bacteriophage is designated APBP19 and includes a polynucleotide sequence as in SEQ ID NO: 19. In an aspect, provided herein is an isolated, purified bacteriophage that includes a polynucleotide sequence with at least 90% identity to SEQ ID NO: 19.

In embodiments, the bacteriophage composition includes a bacteriophage that includes a polynucleotide sequence with at least 80% to 99.9% identity to SEQ ID NO: 19, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 19. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 19. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 19. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 19. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 19. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 19. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 19. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 91% identity to SEQ ID NO: 19. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 19. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 19. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 19. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 19. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 19. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 19. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 19. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 19. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 19. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 19. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 19. In embodiments, the bacteriophage genome comprises the polynucleotide sequence of SEQ ID NO: 19.

In an aspect, provided herein is an isolated, purified bacteriophage that includes a polynucleotide sequence identified as SEQ ID NO: 20. In embodiments, the isolated, purified bacteriophage includes a polynucleotide sequence with at least 90% identity to SEQ ID NO: 20 and is a Myoviridae Pbunavirus bacteriophage. In embodiments, the isolated, purified bacteriophage is designated APBP20 and includes a polynucleotide sequence as in SEQ ID NO: 20. In an aspect, provided herein is an isolated, purified bacteriophage that includes a polynucleotide sequence with at least 90% identity to SEQ ID NO: 20.

In embodiments, the bacteriophage composition includes a bacteriophage that includes a polynucleotide sequence with at least 80% to 99.9% identity to SEQ ID NO: 20, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 20. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 20. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 20. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 20. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 20. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 20. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 20. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 91% identity to SEQ ID NO: 20. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 20. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 20. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 20. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 20. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 20. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 20. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 20. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 20. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 20. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 20. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 20. In embodiments, the bacteriophage genome comprises the polynucleotide sequence of SEQ ID NO: 20.

In an aspect, provided herein is an isolated, purified bacteriophage that includes a polynucleotide sequence identified as SEQ ID NO: 21. In embodiments, the isolated, purified bacteriophage includes a polynucleotide sequence with at least 90% identity to SEQ ID NO: 21 and is a Myoviridae Pbunavirus bacteriophage. In embodiments, the isolated, purified bacteriophage is designated APBP21 and includes a polynucleotide sequence as in SEQ ID NO: 21. In an aspect, provided herein is an isolated, purified bacteriophage that includes a polynucleotide sequence with at least 90% identity to SEQ ID NO: 21.

In embodiments, the bacteriophage composition includes a bacteriophage that includes a polynucleotide sequence with at least 80% to 99.9% identity to SEQ ID NO: 21, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 21. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 21. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 21. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 21. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 21. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 21. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 21.

In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 91% identity to SEQ ID NO: 21. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 21. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 21. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 21. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 21. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 21. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 21. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 21. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 21. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 21. In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 21. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 21. In embodiments, the bacteriophage genome comprises the polynucleotide sequence of SEQ ID NO: 21.

In an aspect, provided herein is an isolated, purified bacteriophage that includes a polynucleotide sequence identified as SEQ ID NO: 22 In embodiments, the isolated, purified bacteriophage includes a polynucleotide sequence with at least 90% identity to SEQ ID NO: 22 and is a Podoviridae Litunavirus bacteriophage. In embodiments, the isolated, purified bacteriophage is designated APBP22 and includes a polynucleotide sequence as in SEQ ID NO: 22. In an aspect, provided herein is an isolated, purified bacteriophage that includes a polynucleotide sequence with at least 90% identity to SEQ ID NO: 22.

In embodiments, the bacteriophage composition includes a bacteriophage that includes a polynucleotide sequence with at least 80% to 99.9% identity to SEQ ID NO: 22, or any sub value or subrange there between, inclusive of endpoints. For example, in embodiments, the bacteriophage composition includes a bacteriophage that includes a polynucleotide sequence with at least 98.9%, 98.8%, 98.7%, 98.6%, 98.5%, 98.4%, 98.3%, 98.2%, 98.1%, 98.0%, or 98% identity to SEQ ID NO: 22. In embodiments, the bacteriophage composition includes a bacteriophage that includes a polynucleotide sequence with at least 97.9%, 97.8%, 97.7%, 97.6%, 97.5%, 97.4%, 97.3%, 97.2%, 97.1%, 97.0%, or 97% identity to SEQ ID NO: 22. In embodiments, the bacteriophage composition includes a bacteriophage that includes a polynucleotide sequence with at least 96.9%, 96.8%, 96.7%, 96.6%, 96.5%, 96.4%, 96.3%, 96.2%, 96.1%, 96.0%, or 96% identity to SEQ ID NO: 22. In embodiments, the bacteriophage composition includes a bacteriophage that includes a polynucleotide sequence with at least 95.9%, 95.8%, 95.7%, 95.6%, 95.5%, 95.4%, 95.3%, 95.2%, 95.1%, 95.0%, or 95% identity to SEQ ID NO: 22. In embodiments, the bacteriophage composition includes a bacteriophage that includes a polynucleotide sequence with at least 94.9%, 94.8%, 94.7%, 94.6%, 94.5%, 94.4%, 94.3%, 94.2%, 94.1%, 94.0%, or 94% identity to SEQ ID NO: 22. In embodiments, the bacteriophage composition includes a bacteriophage that includes a polynucleotide sequence with at least 93.9%, 93.8%, 93.7%, 93.6%, 93.5%, 93.4%, 93.3%, 93.2%, 93.1%, 93.0%, or 93% identity to SEQ ID NO: 22. In embodiments, the bacteriophage composition includes a bacteriophage that includes a polynucleotide sequence with at least 92.9%, 92.8%, 92.7%, 92.6%, 92.5%, 92.4%, 92.3%, 92.2%, 92.1%, 92.0%, or 92% identity to SEQ ID NO: 22. In embodiments, the bacteriophage composition includes a bacteriophage that includes a polynucleotide sequence with at least 91.9%, 91.8%, 91.7%, 91.6%, 91.5%, 91.4%, 91.3%, 91.2%, 91.1%, 91.0%, or 91% identity to SEQ ID NO: 22. In embodiments, the bacteriophage composition includes a bacteriophage that includes a polynucleotide sequence with at least 90.9%, 90.8%, 90.7%, 90.6%, 90.5%, 90.4%, 90.3%, 90.2%, 90.1%, 90.0%, or 90% identity to SEQ ID NO: 22. In embodiments, the bacteriophage composition includes a bacteriophage that includes a polynucleotide sequence with at least 89.9%, 89.8%, 89.7%, 89.6%, 89.5%, 89.4%, 89.3%, 89.2%, 89.1%, 89.0%, or 89% identity to SEQ ID NO: 22. In embodiments, the bacteriophage composition includes a bacteriophage that includes a polynucleotide sequence with at least 88.9%, 88.8%, 88.7%, 88.6%, 88.5%, 88.4%, 88.3%, 88.2%, 88.1%, 88.0%, or 88% identity to SEQ ID NO: 22. In embodiments, the bacteriophage composition includes a bacteriophage that includes a polynucleotide sequence with at least 87.9%, 87.8%, 87.7%, 87.6%, 87.5%, 87.4%, 87.3%, 87.2%, 87.1%, 87.0%, or 87% identity to SEQ ID NO: 22. In embodiments, the bacteriophage composition includes a bacteriophage that includes a polynucleotide sequence with at least 86.9%, 86.8%, 86.7%, 86.6%, 86.5%, 86.4%, 86.3%, 86.2%, 86.1%, 86.0%, or 86% identity to SEQ ID NO: 22. In embodiments, the bacteriophage composition includes a bacteriophage that includes a polynucleotide sequence with at least 85.9%, 85.8%, 85.7%, 85.6%, 85.5%, 85.4%, 85.3%, 85.2%, 85.1%, 85.0%, or 85% identity to SEQ ID NO: 22. In embodiments, the bacteriophage composition includes a bacteriophage that includes a polynucleotide sequence with at least 84.9%, 84.8%, 84.7%, 84.6%, 84.5%, 84.4%, 84.3%, 84.2%, 84.1%, 84.0%, or 84% identity to SEQ ID NO: 22. In embodiments, the bacteriophage composition includes a bacteriophage that includes a polynucleotide sequence with at least 83.9%, 83.8%, 83.7%, 83.6%, 83.5%, 83.4%, 83.3%, 83.2%, 83.1%, 83.0%, or 83% identity to SEQ ID NO: 22. In embodiments, the bacteriophage composition includes a bacteriophage that includes a polynucleotide sequence with at least 82.9%, 82.8%, 82.7%, 82.6%, 82.5%, 82.4%, 82.3%, 82.2%, 82.1%, 82.0%, or 82% identity to SEQ ID NO: 22.

In embodiments, the bacteriophage composition includes a bacteriophage that includes a polynucleotide sequence with at least 81.9%, 81.8%, 81.7%, 81.6%, 81.5%, 81.4%, 81.3%, 81.2%, 81.1%, 81.0%, or 81% identity to SEQ ID NO: 22. In embodiments, the bacteriophage composition includes a bacteriophage that includes a polynucleotide sequence with at least 80.9%, 80.8%, 80.7%, 80.6%, 80.5%, 80.4%, 80.3%, 80.2%, 80.1%, 80.0%, or 80% identity to SEQ ID NO: 22. In embodiments, the bacteriophage genome comprises the polynucleotide sequence of SEQ ID NO: 22.

For any of the embodiments and disclosure herein, a range including, but not necessarily limited to, 80.0% to 99.9% includes any subvalue or subrange therein, including endpoints.

When taking into consideration sequence identity, one must keep in mind that the genetic code is degenerate, and, as such, two nucleotide sequences can differ significantly and yet still encode the same amino acid sequence.

In embodiments, the bacteriophage compositions described herein encompass any bacteriophage that targets bacteria within the genus *Pseudomonas*.

In an aspect, provided herein are bacteriophage compositions that include one or more bacteriophages.

In an aspect, provided herein are bacteriophage compositions that include one or more bacteriophages selected from a bacteriophage including a polynucleotide sequence of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22. In an aspect, provided herein are bacteriophage compositions that include one or more bacteriophages selected from a bacteriophage including a polynucleotide sequence with at least 90% identity to SEQ ID NO: 1, a polynucleotide sequence with at least 90% identity to SEQ ID NO: 2, a polynucleotide sequence with at least 90% identity to SEQ ID NO: 3, a polynucleotide sequence with at least 90% identity to SEQ ID NO: 4, a polynucleotide sequence with at least 90% identity to SEQ ID NO: 5, a polynucleotide sequence with at least 90% identity to SEQ ID NO: 6, a polynucleotide sequence with at least 90% identity to SEQ ID NO: 7, a polynucleotide sequence with at least 93% identity to SEQ ID NO: 8, a polynucleotide sequence with at least 93% identity to SEQ ID NO: 9, a polynucleotide sequence with at least 89% identity to SEQ ID NO: 10, a polynucleotide sequence with at least 95% identity to SEQ ID NO: 11, a polynucleotide sequence with at least 91% identity to SEQ ID NO: 12, a polynucleotide sequence with at least 92% identity to SEQ ID NO: 13, a polynucleotide sequence with at least 96% identity to SEQ ID NO: 14, a polynucleotide sequence with at least 95% identity to SEQ ID NO: 15, a polynucleotide sequence with at least 90% identity to SEQ ID NO: 16, a polynucleotide sequence with at least 92% identity to SEQ ID NO: 17, a polynucleotide sequence with at least 95% identity to SEQ ID NO: 18, a polynucleotide sequence with at least 96% identity to SEQ ID NO: 19, a polynucleotide sequence with at least 96% identity to SEQ ID NO: 20, a polynucleotide sequence with at least 96% identity to SEQ ID NO: 21, or a polynucleotide sequence with at least 95% identity to SEQ ID NO: 22. In some aspects, one or more phage that comprise a sequence having at least 80%-100% sequence identify to one or more of SEQ ID NOs: 1-22 can be explicitly excluded from the various aspects and embodiments described herein.

In embodiments, the bacteriophage composition includes two or more bacteriophages that includes a polynucleotide sequence selected from the polynucleotide sequence of SEQ ID NO: 1, a polynucleotide sequence of SEQ ID NO: 2, a polynucleotide sequence of SEQ ID NO: 3, a polynucleotide sequence with at least 90% identity to SEQ ID NO: 1, a polynucleotide sequence with at least 90% identity to SEQ ID NO: 2, and/or a polynucleotide sequence with at least 90% identity to SEQ ID NO: 3.

In embodiments, the bacteriophage composition includes three or more bacteriophages that includes a polynucleotide sequence selected from the polynucleotide sequence of SEQ ID NO: 1, a polynucleotide sequence of SEQ ID NO: 2, a polynucleotide sequence of SEQ ID NO: 3, a polynucleotide sequence with at least 90% identity to SEQ ID NO: 1, a polynucleotide sequence with at least 90% identity to SEQ ID NO: 2, and/or a polynucleotide sequence with at least 90% identity to SEQ ID NO: 3.

In embodiments, the bacteriophage composition includes a bacteriophage that includes a polynucleotide sequence of SEQ ID NO: 1. In embodiments, the bacteriophage composition includes a bacteriophage that includes a polynucleotide sequence of SEQ ID NO: 1. In embodiments, the bacteriophage composition includes a bacteriophage that includes a polynucleotide sequence with at least 99% identity to SEQ ID NO: 1. In embodiments, the bacteriophage composition includes a bacteriophage that includes a polynucleotide sequence with at least 98% identity to SEQ ID NO: 1. In embodiments, the bacteriophage composition includes a bacteriophage e that includes a polynucleotide sequence with at least 97% identity to SEQ ID NO: 1. In embodiments, the bacteriophage composition includes a bacteriophage that includes a polynucleotide sequence with at least 96% identity to SEQ ID NO: 1. In embodiments, the bacteriophage composition includes a bacteriophage that includes a polynucleotide sequence with at least 95% identity to SEQ ID NO: 1. In embodiments, the bacteriophage composition includes a bacteriophage that includes a polynucleotide sequence with at least 94% identity to SEQ ID NO: 1. In embodiments, the bacteriophage composition includes a bacteriophage that includes a polynucleotide sequence with at least 93% identity to SEQ ID NO: 1. In embodiments, the bacteriophage composition includes a bacteriophage that includes a polynucleotide sequence with at least 92% identity to SEQ ID NO: 1. In embodiments, the bacteriophage composition includes a bacteriophage that includes a polynucleotide sequence with at least 91% identity to SEQ ID NO: 1. In embodiments, the bacteriophage composition includes a bacteriophage that includes a polynucleotide sequence with at least 90% identity to SEQ ID NO: 1. In embodiments, the bacteriophage composition includes a bacteriophage that includes a polynucleotide sequence with at least 89% identity to SEQ ID NO: 1. In embodiments, the bacteriophage composition includes a bacteriophage that includes a polynucleotide sequence with at least 88% identity to SEQ ID NO: 1. In embodiments, the bacteriophage composition includes a bacteriophage that includes a polynucleotide sequence with at least 87% identity to SEQ ID NO: 1. In embodiments, the bacteriophage composition includes a bacteriophage that includes a polynucleotide sequence with at least 86% identity to SEQ ID NO: 1. In embodiments, the bacteriophage composition includes a bacteriophage that includes a polynucleotide sequence with at least 85% identity to SEQ ID NO: 1. In embodiments, the bacteriophage genome comprises the polynucleotide.

In embodiments, the bacteriophage composition includes a bacteriophage that includes a polynucleotide sequence with at least 99% identity to SEQ ID NO: 2. In embodiments, the bacteriophage composition includes a bacteriophage that includes a polynucleotide sequence with at least 98% identity to SEQ ID NO: 2. In embodiments, the bacteriophage composition includes a bacteriophage that includes a polynucleotide sequence with at least 97% identity to SEQ ID NO: 2. In embodiments, the bacteriophage composition includes a bacteriophage that includes a polynucleotide sequence with at least 96% identity to SEQ ID NO: 2. In embodiments, the bacteriophage composition includes a bacteriophage that includes a polynucleotide sequence with at least 95% identity to SEQ ID NO: 2. In embodiments, the bacteriophage composition includes a bacteriophage that includes a polynucleotide sequence with at least 94% identity to SEQ ID NO: 2. In embodiments, the bacteriophage composition includes a bacteriophage that includes a polynucleotide sequence with at least 93% identity to SEQ ID NO: 2. In embodiments, the bacteriophage composition includes a bacteriophage that includes a polynucleotide sequence with at least 92% identity to SEQ ID NO: 2. In embodiments, the bacteriophage composition includes a bacteriophage that includes a polynucleotide sequence with at least 91% identity to SEQ ID NO: 2. In embodiments, the bacteriophage composition includes a bacteriophage that includes a polynucleotide sequence with at least 90% identity to SEQ ID NO: 2. In embodiments, the bacteriophage composition includes a bacteriophage that includes a polynucleotide sequence with at least 89% identity to SEQ ID NO: 2. In embodiments, the bacteriophage composition includes a bacteriophage that includes a polynucleotide sequence with at least 88% identity to SEQ ID NO: 2. In embodiments, the bacteriophage composition includes a bacteriophage that includes a polynucleotide sequence with at least 87% identity to SEQ ID NO: 2. In embodiments, the bacteriophage composition includes a bacteriophage that includes a polynucleotide sequence with at least 86% identity to SEQ ID NO: 2. In embodiments, the bacteriophage composition includes a bacteriophage that includes a polynucleotide sequence with at least 85% identity to SEQ ID NO: 2. In embodiments, the bacteriophage genome comprises the polynucleotide.

In embodiments, the bacteriophage composition includes a bacteriophage that includes a polynucleotide sequence with at least 99% identity to SEQ ID NO: 3. I In embodiments, the bacteriophage composition includes a bacteriophage that includes a polynucleotide sequence with at least 98% identity to SEQ ID NO: 3. In embodiments, the bacteriophage composition includes a bacteriophage that includes a polynucleotide sequence with at least 97% identity to SEQ ID NO: 3. In embodiments, the bacteriophage composition includes a bacteriophage that includes a polynucleotide sequence with at least 96% identity to SEQ ID NO: 3. In embodiments, the bacteriophage composition includes a bacteriophage that includes a polynucleotide sequence with at least 95% identity to SEQ ID NO: 3. In embodiments, the bacteriophage composition includes a bacteriophage that includes a polynucleotide sequence with at least 94% identity to SEQ ID NO: 3. In embodiments, the bacteriophage composition includes a bacteriophage that includes a polynucleotide sequence with at least 93% identity to SEQ ID NO: 3. In embodiments, the bacteriophage composition includes a bacteriophage that includes a polynucleotide sequence with at least 92% identity to SEQ ID NO: 3. In embodiments, the bacteriophage composition includes a bacteriophage that includes a polynucleotide sequence with at least 91% identity to SEQ ID NO: 3. In embodiments, the bacteriophage composition includes a bacteriophage that includes a polynucleotide sequence with at least 90% identity to SEQ ID NO: 3. In embodiments, the bacteriophage composition includes a bacteriophage that includes a polynucleotide sequence with at least 89% identity to SEQ ID NO: 3. In embodiments, the bacteriophage composition includes a bacteriophage that includes a polynucleotide sequence with at least 88% identity to SEQ ID NO: 3. In embodiments, the bacteriophage composition includes a bacteriophage that includes a polynucleotide sequence with at least 87% identity to SEQ ID NO: 3. In embodiments, the bacteriophage composition includes a bacteriophage that includes a polynucleotide sequence with at least 86% identity to SEQ ID NO: 3. In embodiments, the bacteriophage composition includes a bacteriophage that includes a polynucleotide sequence with at least 85% identity to SEQ ID NO: 3. In embodiments, the bacteriophage genome comprises the polynucleotide.

In embodiments, the bacteriophage composition includes two or more bacteriophage that includes a polynucleotide sequence selected from the polynucleotide sequence of SEQ ID NO: 1, a polynucleotide sequence of SEQ ID NO: 2, a polynucleotide sequence of SEQ ID NO: 3, a polynucleotide sequence with at least 93% identity to SEQ ID NO: 1, a polynucleotide sequence with at least 93% identity to SEQ ID NO: 2, and/or a polynucleotide sequence with at least 93% identity to SEQ ID NO: 3.

In embodiments, the bacteriophage composition includes two or more bacteriophages comprising a polynucleotide sequence selected from the polynucleotide sequence of SEQ ID NO: 1, the polynucleotide sequence of SEQ ID NO: 2, the polynucleotide sequence of SEQ ID NO: 3, the polynucleotide sequence with at least 90% identity to SEQ ID NO: 1, the polynucleotide sequence with at least 90% identity to SEQ ID NO: 2, and/or the polynucleotide sequence with at least 90% identity to SEQ ID NO: 3; and wherein the composition's target bacteria range is broader than the cumulative range of the individual bacteriophages in the composition.

In embodiments, the bacteriophage composition includes two or more bacteriophages comprising a polynucleotide sequence selected from the polynucleotide sequence of SEQ ID NO: 4, the polynucleotide sequence of SEQ ID NO: 5, the polynucleotide sequence of SEQ ID NO: 6, the polynucleotide sequence with at least 93% identity to SEQ ID NO: 4, the polynucleotide sequence with at least 93% identity to SEQ ID NO: 5, and/or the polynucleotide sequence with at least 93% identity to SEQ ID NO: 6; and wherein the composition's target bacteria range is broader than the cumulative range of the individual bacteriophages in the composition.

In embodiments, the bacteriophage composition includes two or more bacteriophages comprising a polynucleotide sequence selected from the polynucleotide sequence of SEQ ID NO: 4, the polynucleotide sequence of SEQ ID NO: 5, the polynucleotide sequence of SEQ ID NO: 6, the polynucleotide sequence with at least 90% identity to SEQ ID NO: 4, the polynucleotide sequence with at least 90% identity to SEQ ID NO: 5, and/or the polynucleotide sequence with at least 90% identity to SEQ ID NO: 6; and wherein the composition's target bacteria range is broader than the cumulative range of the individual bacteriophages in the composition.

In embodiments, the bacteriophage composition includes three or more bacteriophages comprising a polynucleotide sequence selected from the polynucleotide sequence of SEQ ID NO: 1, the polynucleotide sequence of SEQ ID NO: 2, the polynucleotide sequence of SEQ ID NO: 3, the polynucleotide sequence with at least 93% identity to SEQ ID NO: 1, the polynucleotide sequence with at least 93% identity to SEQ ID NO: 2, and/or the polynucleotide sequence with at least 93% identity to SEQ ID NO: 3; and wherein the composition's target bacteria range is broader than the cumulative range of the individual bacteriophages in the composition.

In embodiments, the bacteriophage composition includes three or more bacteriophages comprising a polynucleotide sequence selected from the polynucleotide sequence of SEQ ID NO: 1, the polynucleotide sequence of SEQ ID NO: 2, the polynucleotide sequence of SEQ ID NO: 3, the polynucleotide sequence with at least 90% identity to SEQ ID NO: 1, the polynucleotide sequence with at least 90% identity to SEQ ID NO: 2, and/or the polynucleotide sequence with at least 90% identity to SEQ ID NO: 3; and wherein the composition's target bacteria range is broader than the cumulative range of the individual bacteriophages in the composition.

In embodiments, the bacteriophage composition includes three or more bacteriophages comprising a polynucleotide sequence selected from the polynucleotide sequence of SEQ ID NO: 4, the polynucleotide sequence of SEQ ID NO: 5, the polynucleotide sequence of SEQ ID NO: 6, the polynucleotide sequence with at least 93% identity to SEQ ID NO: 4, the polynucleotide sequence with at least 93% identity to SEQ ID NO: 5, and/or the polynucleotide sequence with at least 93% identity to SEQ ID NO: 6; and wherein the composition's target bacteria range is broader than the cumulative range of the individual bacteriophages in the composition.

In embodiments, the bacteriophage composition includes three or more bacteriophages comprising a polynucleotide sequence selected from the polynucleotide sequence of SEQ ID NO: 4, the polynucleotide sequence of SEQ ID NO: 5, the polynucleotide sequence of SEQ ID NO: 6, the polynucleotide sequence with at least 90% identity to SEQ ID NO: 4, the polynucleotide sequence with at least 90% identity to SEQ ID NO: 5, and/or the polynucleotide sequence with at least 90% identity to SEQ ID NO: 6; and wherein the composition's target bacteria range is broader than the cumulative range of the individual bacteriophages in the composition.

In embodiments, the bacteriophage composition includes three or more bacteriophages including a polynucleotide sequence selected from the polynucleotide sequence of SEQ ID NO: 1, the polynucleotide sequence of SEQ ID NO: 2, the polynucleotide sequence of SEQ ID NO: 3, the polynucleotide sequence with at least 93% identity to SEQ ID NO: 1, the polynucleotide sequence with at least 93% identity to SEQ ID NO: 2, and/or the polynucleotide sequence with at least 93% identity to SEQ ID NO: 3; and in addition, at least one bacteriophage including a polynucleotide sequence selected from the polynucleotide sequence of SEQ ID NO: 4, the polynucleotide sequence of SEQ ID NO: 5, the polynucleotide sequence of SEQ ID NO: 6, a polynucleotide sequence with at least 93% identity to SEQ ID NO: 4, a polynucleotide sequence with at least 93% identity to SEQ ID NO: 5, and a polynucleotide sequence with at least 93% identity to SEQ ID NO: 6; and wherein the composition's target bacteria range is broader than the cumulative range of the individual bacteriophages in the composition.

In embodiments, the bacteriophage composition includes three or more bacteriophages including a polynucleotide sequence selected from the polynucleotide sequence of SEQ ID NO: 1, the polynucleotide sequence of SEQ ID NO: 2, the polynucleotide sequence of SEQ ID NO: 3, the polynucleotide sequence with at least 90% identity to SEQ ID NO: 1, the polynucleotide sequence with at least 90% identity to SEQ ID NO: 2, and/or the polynucleotide sequence with at least 90% identity to SEQ ID NO: 3; and in addition, at least one bacteriophage including a polynucleotide sequence selected from the polynucleotide sequence of SEQ ID NO: 4, the polynucleotide sequence of SEQ ID NO: 5, the polynucleotide sequence of SEQ ID NO: 6, a polynucleotide sequence with at least 90% identity to SEQ ID NO: 4, a polynucleotide sequence with at least 90% identity to SEQ ID NO: 5, and a polynucleotide sequence with at least 90% identity to SEQ ID NO: 6; and wherein the composition's target bacteria range is broader than the cumulative range of the individual bacteriophages in the composition.

In embodiments, the bacteriophage composition includes three or more bacteriophages including a polynucleotide sequence selected from the polynucleotide sequence of SEQ ID NO: 1, the polynucleotide sequence of SEQ ID NO: 2, the polynucleotide sequence of SEQ ID NO: 3, the polynucleotide sequence with at least 90% identity to SEQ ID NO: 1, the polynucleotide sequence with at least 90% identity to SEQ ID NO: 2, and/or the polynucleotide sequence with at least 90% identity to SEQ ID NO: 3; and in addition, at least two bacteriophages including a polynucleotide sequence selected from the polynucleotide sequence of SEQ ID NO: 4, the polynucleotide sequence of SEQ ID NO: 5, the polynucleotide sequence of SEQ ID NO: 6, a polynucleotide sequence with at least 90% identity to SEQ ID NO: 4, a polynucleotide sequence with at least 90% identity to SEQ ID NO: 5, and a polynucleotide sequence with at least 90% identity to SEQ ID NO: 6; and wherein the composition's target bacteria range is broader than the cumulative range of the individual bacteriophages in the composition.

In an embodiment, provided herein is a bacteriophage composition comprising a bacteriophage including a polynucleotide sequence of SEQ ID NO: 1, a bacteriophage including a polynucleotide sequence of SEQ ID NO: 2, and a bacteriophage including a polynucleotide sequence of SEQ ID NO: 3. In an embodiment, provided herein is a bacteriophage composition comprising a bacteriophage including a polynucleotide sequence of SEQ ID NO: 1, a bacteriophage including a polynucleotide sequence of SEQ ID NO: 2, a bacteriophage including a polynucleotide sequence of SEQ ID NO: 3, and a bacteriophage including a polynucleotide sequence of SEQ ID NO: 4. In an embodiment, provided herein is a bacteriophage composition comprising a bacteriophage including a polynucleotide sequence of SEQ ID NO: 1, a bacteriophage including a polynucleotide sequence of SEQ ID NO: 2, a bacteriophage including a polynucleotide sequence of SEQ ID NO: 3, a bacteriophage including a polynucleotide sequence of SEQ ID NO: 4, and a bacteriophage including a polynucleotide sequence of SEQ ID NO: 5. In an embodiment, provided herein is a bacteriophage composition comprising a bacteriophage including a polynucleotide sequence of SEQ ID NO: 1, a bacteriophage including a polynucleotide sequence of SEQ ID NO: 2, a bacteriophage including a polynucleotide sequence of SEQ ID NO: 3, a bacteriophage including a polynucleotide sequence of SEQ ID NO: 4, a bacteriophage including a polynucleotide sequence of SEQ ID NO: 5, and a bacteriophage including a polynucleotide sequence of SEQ ID NO: 6.

In an embodiment, provided herein is a bacteriophage composition comprising a bacteriophage including a polynucleotide sequence with at least 93% identity to SEQ ID NO: 1, a bacteriophage including a polynucleotide sequence with at least 93% identity to SEQ ID NO: 2, and a bacteriophage including a polynucleotide sequence with at least 93% identity to SEQ ID NO: 3. In an embodiment, provided herein is a bacteriophage composition comprising a bacteriophage including a polynucleotide sequence with at least 93% identity to SEQ ID NO: 1, a bacteriophage including a polynucleotide sequence with at least 93% identity to SEQ ID NO: 2, a bacteriophage including polynucleotide sequence of SEQ ID NO: 3, a bacteriophage including a polynucleotide sequence with at least 93% identity to SEQ ID NO: 4, and a bacteriophage including a polynucleotide sequence with at least 93% identity to SEQ ID NO: 5. In an embodiment, provided herein is a bacteriophage composition comprising a bacteriophage including a polynucleotide sequence with at least 93% identity to SEQ ID NO: 1, a bacteriophage including a polynucleotide sequence with at least 93% identity to SEQ ID NO: 2, a bacteriophage including polynucleotide sequence of SEQ ID NO: 3, a bacteriophage including a polynucleotide sequence with at least 93% identity to SEQ ID NO: 4, a bacteriophage including a polynucleotide sequence with at least 93% identity to SEQ ID NO: 5, and a bacteriophage including a polynucleotide sequence with at least 93% identity to SEQ ID NO: 6.

In an embodiment, provided herein is a bacteriophage composition comprising a bacteriophage including a polynucleotide sequence with at least 90% identity to SEQ ID NO: 1, a bacteriophage including a polynucleotide sequence with at least 90% identity to SEQ ID NO: 2, and a bacteriophage including a polynucleotide sequence with at least 90% identity to SEQ ID NO: 3. In an embodiment, provided herein is a bacteriophage composition comprising a bacteriophage including a polynucleotide sequence with at least 90% identity to SEQ ID NO: 1, a bacteriophage including a polynucleotide sequence with at least 90% identity to SEQ ID NO: 2, a bacteriophage including polynucleotide sequence of SEQ ID NO: 3, a bacteriophage including a polynucleotide sequence with at least 90% identity to SEQ ID NO: 4, and a bacteriophage including a polynucleotide sequence with at least 90% identity to SEQ ID NO: 5. In an embodiment, provided herein is a bacteriophage composition comprising a bacteriophage including a polynucleotide sequence with at least 90% identity to SEQ ID NO: 1, a bacteriophage including a polynucleotide sequence with at least 90% identity to SEQ ID NO: 2, a bacteriophage including polynucleotide sequence of SEQ ID NO: 3, a bacteriophage including a polynucleotide sequence with at least 90% identity to SEQ ID NO: 4, a bacteriophage including a polynucleotide sequence with at least 90% identity to SEQ ID NO: 5, and a bacteriophage including a polynucleotide sequence with at least 90% identity to SEQ ID NO: 6.

In embodiments, provided herein are bacteriophage compositions that include a bacteriophage according to any embodiment described herein. In embodiments, provided herein are bacteriophage compositions that include two or more bacteriophages according to any embodiment described herein. In embodiments, provided herein are bacteriophage compositions that include three or more bacteriophages according to any embodiment described herein. In embodiments, provided herein are bacteriophage compositions that include four or more bacteriophages according to any embodiment described herein. In embodiments, provided herein are bacteriophage compositions that include five or more bacteriophages according to any embodiment described herein. In embodiments, provided herein are bacteriophage compositions that include six or more bacteriophages according to any embodiment described herein.

In some embodiments, any of the combinations of bacteriophage listed herein can further comprise an additional bacteriophage that is any naturally occurring phage, a mutated naturally occurring phage, and/or a partially or fully synthetic phage, particularly where the additional bacteriophage has the ability to infect, kill, or reduce a bacterial infection. In specific embodiments, the composition envisioned herein may comprise at least one of the bacteriophages described herein and an additional naturally occurring phage, a mutated naturally occurring phage, and/or a partially or fully synthetic phage, including where the additional bacteriophage has the ability to infect, kill, or reduce a bacterial infection. In specific embodiments, the composition envisioned herein may comprise more than one of the bacteriophages described herein and an additional naturally occurring phage, mutated naturally phage, and/or a partially or fully synthetic phage, particularly where the additional bacteriophage has the ability to infect, kill, or reduce a bacterial infection.

In embodiments, the bacteriophage composition includes one or more bacteriophage that are resistant to inactivation in the sputum. In embodiments, the bacteriophage composition includes two or more bacteriophages that are resistant to inactivation in the sputum. In embodiments, the bacteriophage composition includes three or more bacteriophages that are resistant to inactivation in the sputum. In embodiments, the bacteriophage composition includes four or more bacteriophages that are resistant to inactivation in the sputum. In embodiments, the bacteriophage composition includes five or more bacteriophages that are resistant to inactivation in the sputum. In embodiments, the bacteriophage composition includes six or more bacteriophages that are resistant to inactivation in the sputum.

In embodiments, the bacteriophage composition includes one or more bacteriophages that persist in the lung and/or bronchoalveolar lavage fluid up to 48 hours after administration. In embodiments, the bacteriophage composition includes one or more bacteriophages that persist in the lung and/or bronchoalveolar lavage fluid up to 12 hours after administration. In embodiments, the bacteriophage composition includes one or more bacteriophages that persist in the lung and/or bronchoalveolar lavage fluid up to 24 hours after administration. In embodiments, the bacteriophage composition includes one or more bacteriophages that persist in the lung and/or bronchoalveolar lavage fluid up to 36 hours after administration. In embodiments, the bacteriophage composition includes one or more bacteriophages that persist in the lung and/or bronchoalveolar lavage fluid 48 hours after administration. In embodiments, the bacteriophage composition includes one or more bacteriophages that persist in the lung and/or bronchoalveolar lavage fluid more than 48 hours after administration.

In embodiments, the bacteriophage composition includes one or more bacteriophages that maintain activity in the presence of a pulmonary treatment selected from salbutamol, tobramycin, aztreonam, colistin, inhaled hypertonic saline, and inhaled beta-agonist. In embodiments, the bacteriophage composition includes one or more bacteriophages that maintain activity in the presence of salbutamol. In embodiments, the bacteriophage composition includes one or more bacteriophages that maintain activity in the presence of tobramycin. In embodiments, the bacteriophage composition includes one or more bacteriophages that maintain activity in the presence of aztreonam. In embodiments, the bacteriophage composition includes one or more bacteriophages that maintain activity in the presence of colistin. In embodiments, the bacteriophage composition includes one or more bacteriophages that maintain activity in the presence of an inhaled hypertonic saline. In embodiments, the bacteriophage composition includes one or more bacteriophages that maintain activity in the presence of an inhaled beta-agonist.

In embodiments, the bacteriophage composition includes bacteriophages that target *Pseudomonas aeruginosa*. In embodiments, the bacteriophage composition includes bacteriophages that target antibiotic-resistant *Pseudomonas aeruginosa*. In embodiments, the bacteriophage composition includes bacteriophages that target multiple antibiotic-resistant *Pseudomonas aeruginosa*.

In embodiments, the bacteriophage composition includes bacteriophages that infect and kill *Pseudomonas aeruginosa*. In embodiments, the bacteriophage composition includes bacteriophages that infect and kill antibiotic-resistant *Pseudomonas aeruginosa*. In embodiments, the bacteriophage composition includes bacteriophages that infect and kill multiple antibiotic-resistant *Pseudomonas aeruginosa*.

In embodiments, provided herein are bacteriophage compositions that include one or more bacteriophages that belong to the family Myoviridae. In embodiments, the bacteriophage composition includes a bacteriophage belonging to the genus Pbunavirus. In embodiments, the bacteriophage composition includes a bacteriophage belonging to the genus Pakpunavirus. In embodiments, the bacteriophage composition includes a bacteriophage belonging to the genus Nankokuvirus. In embodiments, the bacteriophage composition includes a bacteriophage belonging to the family Podoviridae. In embodiments, the bacteriophage composition includes a bacteriophage belonging to the genus Phikmvvirus. In embodiments, the bacteriophage composition includes a bacteriophage belonging to the genus Litunavirus. In embodiments, the bacteriophage composition includes a bacteriophage belonging to the genus Bruynoghevirus. In embodiments, the bacteriophage composition includes a bacteriophage belonging to the genus Luzseptimavirus.

In embodiments, the bacteriophage composition is substantially free of a bacterial component. In embodiments, the bacteriophage composition is substantially free of bacterial host protein and/or exotoxin. In embodiments, the bacteriophage composition is substantially free of bacterial host protein. In embodiments, the bacteriophage composition is substantially free of bacterial exotoxin.

In embodiments, the bacteriophage composition includes one or more additional bacteriophages. In some embodiments, the one or more additional bacteriophages are suitable for treating a bacterial infection, in particular a *Pseudomonas aeruginosa* infection. In embodiments, the additional one or more phage can be natural or non-naturally occurring. In embodiments, the one or more additional phage can be a phage with at least 93% nucleic acid sequence identity to any of the phage described herein. In embodiments, the one or more additional phage can be a phage with at least 93% nucleic acid sequence identity to SEQ ID NO: 1. In embodiments, the one or more additional phage can be a phage with at least 93% nucleic acid sequence identity to SEQ ID NO: 2. In embodiments, the one or more additional phage can be a phage with at least 93% nucleic acid sequence identity to SEQ ID NO: 3. In embodiments, the bacteriophages include a polynucleotide sequence with at least 93% but not 100% identity to any one of SEQ ID NO: 1, SEQ ID NO: 2, or SEQ ID NO: 3.

In embodiments, the bacteriophage composition includes one or more additional bacteriophages. In some embodiments, the one or more additional bacteriophages are suitable for treating a bacterial infection, in particular a *Pseudomonas aeruginosa* infection. In embodiments, the additional one or more phage can be natural or non-naturally occurring. In embodiments, the one or more additional phage can be a phage with at least 90% nucleic acid sequence identity to any of the phage described herein. In embodiments, the one or more additional phage can be a phage with at least 90% nucleic acid sequence identity to SEQ ID NO: 1. In embodiments, the one or more additional phage can be a phage with at least 90% nucleic acid sequence identity to SEQ ID NO: 2. In embodiments, the one or more additional phage can be a phage with at least 90% nucleic acid sequence identity to SEQ ID NO: 3. In embodiments, the bacteriophages include a polynucleotide sequence with at least 90% but not 100% identity to any one of SEQ ID NO: 1, SEQ ID NO: 2, or SEQ ID NO: 3.

In some embodiments, the composition's target bacteria range is broader than the cumulative range of the individual bacteriophage in the composition. In embodiments, the range of target bacteria of the bacteriophage composition is broader than the range of target bacteria of any single bacteriophage included within the composition. Such activity can be considered synergistic as the effect of the composition is greater than the sum of individual effects of each component bacteriophage. That is, a composition including two or more bacteriophage may target a broader range than would be expected, based on the target bacteria range of each individual bacteriophage. In embodiments, provided herein are bacteriophage compositions where the composition's target bacteria range can have an effectiveness that is greater than the sum of effectiveness of the individual bacteriophage.

In embodiments, provided herein are bacteriophage compositions that include three or more bacteriophages. For example, such compositions can include one, two or three bacteriophages as described herein. In some aspects provided is a composition of at least three bacteriophages that includes a bacteriophage with polynucleotide sequence of SEQ ID NO: 1 and the composition targets more *Pseudomonas aeruginosa* strains than a bacteriophage with polynucleotide sequence of SEQ ID NO: 1. In embodiments, provided herein are bacteriophage compositions that include three or more bacteriophages, where the composition includes a bacteriophage with a polynucleotide sequence with at least 93% identity with SEQ ID NO: 1 and the composition targets more *Pseudomonas aeruginosa* strains than a bacteriophage with a polynucleotide sequence with at least 93% identity with SEQ ID NO: 1. In embodiments, provided herein are bacteriophage compositions that include three or more bacteriophages, where the composition includes a bacteriophage with polynucleotide sequence of SEQ ID NO: 2 and the composition targets more *Pseudomonas aeruginosa* strains than a bacteriophage with polynucleotide sequence of SEQ ID NO: 2. In embodiments, provided herein are bacteriophage compositions that include three or more bacteriophages, where the composition includes a bacteriophage with a polynucleotide sequence with at least 93% identity with SEQ ID NO: 2 and the composition targets more *Pseudomonas aeruginosa* strains than a bacteriophage with a polynucleotide sequence with at least 93% identity with SEQ ID NO: 2. In embodiments, provided herein are bacteriophage compositions that include three or more bacteriophages, where the composition includes a bacteriophage with polynucleotide sequence of SEQ ID NO: 3 and the composition targets more *Pseudomonas aeruginosa* strains than a bacteriophage with polynucleotide sequence of SEQ ID NO: 3. In embodiments, provided herein are bacteriophage compositions that include three or more bacteriophages, where the composition includes a bacteriophage with a polynucleotide sequence with at least 93% identity with SEQ ID NO: 3 and the composition targets more *Pseudomonas aeruginosa* strains than a bacteriophage with a polynucleotide sequence with at least 93% identity with SEQ ID NO: 3. In embodiments, provided herein are bacteriophage compositions that include three or more bacteriophages, where the composition includes a bacteriophage with polynucleotide sequence of SEQ ID NO: 4 and the composition targets more *Pseudomonas aeruginosa* strains than a bacteriophage with polynucleotide sequence of SEQ ID NO: 4. In embodiments, provided herein are bacteriophage compositions that include three or more bacteriophages, where the composition includes a bacteriophage with a polynucleotide sequence with at least 93% identity with SEQ ID NO: 4 and the composition targets more *Pseudomonas aeruginosa* strains than a bacteriophage with a polynucleotide sequence with at least 93% identity with SEQ ID NO: 4. In embodiments, provided herein are bacteriophage compositions that include three or more bacteriophages, where the composition includes a bacteriophage with polynucleotide sequence of SEQ ID NO: 5 and the composition targets more *Pseudomonas aeruginosa* strains than a bacteriophage with polynucleotide sequence of SEQ ID NO: 5. In embodiments, provided herein are bacteriophage compositions that include three or more bacteriophages, where the composition includes a bacteriophage with a polynucleotide sequence with at least 93% identity with SEQ ID NO: 5 and the composition targets more *Pseudomonas aeruginosa* strains than a bacteriophage with a polynucleotide sequence with at least 93% identity with SEQ ID NO: 5. In embodiments, provided herein are bacteriophage compositions that include three or more bacteriophages, where the composition includes a bacteriophage with polynucleotide sequence of SEQ ID NO: 6 and the composition targets more *Pseudomonas aeruginosa* strains than a bacteriophage with polynucleotide sequence of SEQ ID NO: 6. In embodiments, provided herein are bacteriophage compositions that include three or more bacteriophages, where the composition includes a bacteriophage with a polynucleotide sequence with at least 93% identity with SEQ ID NO: 6 and the composition targets more *Pseudomonas aeruginosa* strains than a bacteriophage with a polynucleotide sequence with at least 93% identity with SEQ ID NO: 6. In embodiments, provided herein are bacteriophage compositions that include three or more bacteriophages, where the composition includes a bacteriophage with polynucleotide sequence of SEQ ID NO: 7 and the composition targets more *Pseudomonas aeruginosa* strains than a bacteriophage with polynucleotide sequence of SEQ ID NO: 7. In embodiments, provided herein are bacteriophage compositions that include three or more bacteriophages, where the composition includes a bacteriophage with a polynucleotide sequence with at least 93% identity with SEQ ID NO: 7 and the composition targets more *Pseudomonas aeruginosa* strains than a bacteriophage with a polynucleotide sequence with at least 93% identity with SEQ ID NO: 7. In embodiments, provided herein are bacteriophage compositions that include three or more bacteriophages, where the composition includes a bacteriophage with polynucleotide sequence of SEQ ID NO: 8 and the composition targets more *Pseudomonas aeruginosa* strains than a bacteriophage with polynucleotide sequence of SEQ ID NO: 8. In embodiments, provided herein are bacteriophage compositions that include three or more bacteriophages, where the composition includes a bacteriophage with a polynucleotide sequence with at least 93% identity with SEQ ID NO: 8 and the composition targets more *Pseudomonas aeruginosa* strains than a bacteriophage with a polynucleotide sequence with at least 93% identity with SEQ ID NO: 8. In embodiments, provided herein are bacteriophage compositions that include three or more bacteriophages, where the composition includes a bacteriophage with polynucleotide sequence of SEQ ID NO: 9 and the composition targets more *Pseudomonas aeruginosa* strains than a bacteriophage with polynucleotide sequence of SEQ ID NO: 9. In embodiments, provided herein are bacteriophage compositions that include three or more bacteriophages, where the composition includes a bacteriophage with a polynucleotide sequence with at least 93% identity with SEQ ID NO: 9 and the composition targets more *Pseudomonas aeruginosa* strains than a bacteriophage with a polynucleotide sequence with at least 93% identity with SEQ ID NO: 9. In embodiments, provided herein are bacteriophage compositions that include three or more bacteriophages, where the composition includes a bacteriophage with polynucleotide sequence of SEQ ID NO: 10 and the composition targets more *Pseudomonas aeruginosa* strains than a bacteriophage with polynucleotide sequence of SEQ ID NO: 10. In embodiments, provided herein are bacteriophage compositions that include three or more bacteriophages, where the composition includes a bacteriophage with a polynucleotide sequence with at least 93% identity with SEQ ID NO: 10 and the composition targets more *Pseudomonas aeruginosa* strains than a bacteriophage with a polynucleotide sequence with at least 93% identity with SEQ ID NO: 10. In embodiments, provided herein are bacteriophage compositions that include three or more bacteriophages, where the composition includes a bacteriophage with polynucleotide sequence of SEQ ID NO: 11 and the composition targets more *Pseudomonas aeruginosa* strains than a bacteriophage with polynucleotide sequence of SEQ ID NO: 11. In embodiments, provided herein are bacteriophage compositions that include three or more bacteriophages, where the composition includes a bacteriophage with a polynucleotide sequence with at least 93% identity with SEQ ID NO: 11 and the composition targets more *Pseudomonas aeruginosa* strains than a bacteriophage with a polynucleotide sequence with at least 93% identity with SEQ ID NO: 11. In embodiments, provided herein are bacteriophage compositions that include three or more bacteriophages, where the composition includes a bacteriophage with polynucleotide sequence of SEQ ID NO: 12 and the composition targets more *Pseudomonas aeruginosa* strains than a bacteriophage with polynucleotide sequence of SEQ ID NO: 12. In embodiments, provided herein are bacteriophage compositions that include three or more bacteriophages, where the composition includes a bacteriophage with a polynucleotide sequence with at least 93% identity with SEQ ID NO: 12 and the composition targets more *Pseudomonas aeruginosa* strains than a bacteriophage with a polynucleotide sequence with at least 93% identity with SEQ ID NO: 12. In embodiments, provided herein are bacteriophage compositions that include three or more bacteriophages, where the composition includes a bacteriophage with polynucleotide sequence of SEQ ID NO: 13 and the composition targets more *Pseudomonas aerugi-*

*nosa* strains than a bacteriophage with polynucleotide sequence of SEQ ID NO: 13. In embodiments, provided herein are bacteriophage compositions that include three or more bacteriophages, where the composition includes a bacteriophage with a polynucleotide sequence with at least 93% identity with SEQ ID NO: 13 and the composition targets more *Pseudomonas aeruginosa* strains than a bacteriophage with a polynucleotide sequence with at least 93% identity with SEQ ID NO: 13. In embodiments, provided herein are bacteriophage compositions that include three or more bacteriophages, where the composition includes a bacteriophage with polynucleotide sequence of SEQ ID NO: 14 and the composition targets more *Pseudomonas aeruginosa* strains than a bacteriophage with polynucleotide sequence of SEQ ID NO: 14. In embodiments, provided herein are bacteriophage compositions that include three or more bacteriophages, where the composition includes a bacteriophage with a polynucleotide sequence with at least 93% identity with SEQ ID NO: 14 and the composition targets more *Pseudomonas aeruginosa* strains than a bacteriophage with a polynucleotide sequence with at least 93% identity with SEQ ID NO: 14. In embodiments, provided herein are bacteriophage compositions that include three or more bacteriophages, where the composition includes a bacteriophage with polynucleotide sequence of SEQ ID NO: 15 and the composition targets more *Pseudomonas aeruginosa* strains than a bacteriophage with polynucleotide sequence of SEQ ID NO: 15 In embodiments, provided herein are bacteriophage compositions that include three or more bacteriophages, where the composition includes a bacteriophage with a polynucleotide sequence with at least 9593 identity with SEQ ID NO: 15 and the composition targets more *Pseudomonas aeruginosa* strains than a bacteriophage with a polynucleotide sequence with at least 93% identity with SEQ ID NO: 15. In embodiments, provided herein are bacteriophage compositions that include three or more bacteriophages, where the composition includes a bacteriophage with polynucleotide sequence of SEQ ID NO: 16 and the composition targets more *Pseudomonas aeruginosa* strains than a bacteriophage with polynucleotide sequence of SEQ ID NO: 16. In embodiments, provided herein are bacteriophage compositions that include three or more bacteriophages, where the composition includes a bacteriophage with a polynucleotide sequence with at least 93% identity with SEQ ID NO: 16 and the composition targets more *Pseudomonas aeruginosa* strains than a bacteriophage with a polynucleotide sequence with at least 93% identity with SEQ ID NO: 16. In embodiments, provided herein are bacteriophage compositions that include three or more bacteriophages, where the composition includes a bacteriophage with polynucleotide sequence of SEQ ID NO: 17 and the composition targets more *Pseudomonas aeruginosa* strains than a bacteriophage with polynucleotide sequence of SEQ ID NO: 17. In embodiments, provided herein are bacteriophage compositions that include three or more bacteriophages, where the composition includes a bacteriophage with a polynucleotide sequence with at least 93% identity with SEQ ID NO: 17 and the composition targets more *Pseudomonas aeruginosa* strains than a bacteriophage with a polynucleotide sequence with at least 93% identity with SEQ ID NO: 17. In embodiments, provided herein are bacteriophage compositions that include three or more bacteriophages, where the composition includes a bacteriophage with polynucleotide sequence of SEQ ID NO: 18 and the composition targets more *Pseudomonas aeruginosa* strains than a bacteriophage with polynucleotide sequence of SEQ ID NO: 18. In embodiments, provided herein are bacteriophage compositions that include three or more bacteriophages, where the composition includes a bacteriophage with a polynucleotide sequence with at least 93% identity with SEQ ID NO: 18 and the composition targets more *Pseudomonas aeruginosa* strains than a bacteriophage with a polynucleotide sequence with at least 93% identity with SEQ ID NO: 18. In embodiments, provided herein are bacteriophage compositions that include three or more bacteriophages, where the composition includes a bacteriophage with polynucleotide sequence of SEQ ID NO: 19 and the composition targets more *Pseudomonas aeruginosa* strains than a bacteriophage with polynucleotide sequence of SEQ ID NO: 19. In embodiments, provided herein are bacteriophage compositions that include three or more bacteriophages, where the composition includes a bacteriophage with a polynucleotide sequence with at least 93% identity with SEQ ID NO: 19 and the composition targets more *Pseudomonas aeruginosa* strains than a bacteriophage with a polynucleotide sequence with at least 93% identity with SEQ ID NO: 19. In embodiments, provided herein are bacteriophage compositions that include three or more bacteriophages, where the composition includes a bacteriophage with polynucleotide sequence of SEQ ID NO: 20 and the composition targets more *Pseudomonas aeruginosa* strains than a bacteriophage with polynucleotide sequence of SEQ ID NO: 20. In embodiments, provided herein are bacteriophage compositions that include three or more bacteriophages, where the composition includes a bacteriophage with a polynucleotide sequence with at least 93% identity with SEQ ID NO: 20 and the composition targets more *Pseudomonas aeruginosa* strains than a bacteriophage with a polynucleotide sequence with at least 93% identity with SEQ ID NO: 20. In embodiments, provided herein are bacteriophage compositions that include three or more bacteriophages, where the composition includes a bacteriophage with polynucleotide sequence of SEQ ID NO: 21 and the composition targets more *Pseudomonas aeruginosa* strains than a bacteriophage with polynucleotide sequence of SEQ ID NO: 21. In embodiments, provided herein are bacteriophage compositions that include three or more bacteriophages, where the composition includes a bacteriophage with a polynucleotide sequence with at least 93% identity with SEQ ID NO: 21 and the composition targets more *Pseudomonas aeruginosa* strains than a bacteriophage with a polynucleotide sequence with at least 93% identity with SEQ ID NO: 21. In embodiments, provided herein are bacteriophage compositions that include three or more bacteriophages, where the composition includes a bacteriophage with polynucleotide sequence of SEQ ID NO: 22 and the composition targets more *Pseudomonas aeruginosa* strains than a bacteriophage with polynucleotide sequence of SEQ ID NO: 22. In embodiments, provided herein are bacteriophage compositions that include three or more bacteriophages, where the composition includes a bacteriophage with a polynucleotide sequence with at least 93% identity with SEQ ID NO: 22 and the composition targets more *Pseudomonas aeruginosa* strains than a bacteriophage with a polynucleotide sequence with at least 93% identity with SEQ ID NO: 22. In embodiments, the compositions can have any combination polynucleotide sequences of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, and SEQ ID NO: 22, and sequence variants of any of the same as described herein.

In embodiments, provided herein are bacteriophage compositions that include three or more bacteriophages, where the composition includes a bacteriophage with polynucleotide sequence of SEQ ID NO: 1 and the composition targets more *Pseudomonas aeruginosa* strains than a bacteriophage with polynucleotide sequence of SEQ ID NO: 1. In embodiments, provided herein are bacteriophage compositions that include three or more bacteriophages, where the composition includes a bacteriophage with a polynucleotide sequence with at least 90% identity with SEQ ID NO: 1 and the composition targets more *Pseudomonas aeruginosa* strains than a bacteriophage with a polynucleotide sequence with at least 90% identity with SEQ ID NO: 1. In embodiments, provided herein are bacteriophage compositions that include three or more bacteriophages, where the composition includes a bacteriophage with polynucleotide sequence of SEQ ID NO: 2 and the composition targets more *Pseudomonas aeruginosa* strains than a bacteriophage with polynucleotide sequence of SEQ ID NO: 2. In embodiments, provided herein are bacteriophage compositions that include three or more bacteriophages, where the composition includes a bacteriophage with a polynucleotide sequence with at least 90% identity with SEQ ID NO: 2 and the composition targets more *Pseudomonas aeruginosa* strains than a bacteriophage with a polynucleotide sequence with at least 90% identity with SEQ ID NO: 2. In embodiments, provided herein are bacteriophage compositions that include three or more bacteriophages, where the composition includes a bacteriophage with polynucleotide sequence of SEQ ID NO: 3 and the composition targets more *Pseudomonas aeruginosa* strains than a bacteriophage with polynucleotide sequence of SEQ ID NO: 3. In embodiments, provided herein are bacteriophage compositions that include three or more bacteriophages, where the composition includes a bacteriophage with a polynucleotide sequence with at least 90% identity with SEQ ID NO: 3 and the composition targets more *Pseudomonas aeruginosa* strains than a bacteriophage with a polynucleotide sequence with at least 90% identity with SEQ ID NO: 3. In embodiments, the compositions can have any combination polynucleotide sequences of SEQ ID NO: 1, SEQ ID NO: 2, and SEQ ID NO: 3.

In embodiments, provided herein are bacteriophage compositions that include three or more bacteriophages, where the composition includes a bacteriophage with polynucleotide sequence of SEQ ID NO: 4 and the composition targets more *Pseudomonas aeruginosa* strains than a bacteriophage with polynucleotide sequence of SEQ ID NO: 4. In embodiments, provided herein are bacteriophage compositions that include three or more bacteriophages, where the composition includes a bacteriophage with a polynucleotide sequence with at least 90% identity with SEQ ID NO: 4 and the composition targets more *Pseudomonas aeruginosa* strains than a bacteriophage with a polynucleotide sequence with at least 90% identity with SEQ ID NO: 4. In embodiments, provided herein are bacteriophage compositions that include three or more bacteriophages, where the composition includes a bacteriophage with polynucleotide sequence of SEQ ID NO: 5 and the composition targets more *Pseudomonas aeruginosa* strains than a bacteriophage with polynucleotide sequence of SEQ ID NO: 5. In embodiments, provided herein are bacteriophage compositions that include three or more bacteriophages, where the composition includes a bacteriophage with a polynucleotide sequence with at least 90% identity with SEQ ID NO: 5 and the composition targets more *Pseudomonas aeruginosa* strains than a bacteriophage with a polynucleotide sequence with at least 90% identity with SEQ ID NO: 5. In embodiments, provided herein are bacteriophage compositions that include three or more bacteriophages, where the composition includes a bacteriophage with polynucleotide sequence of SEQ ID NO: 6 and the composition targets more *Pseudomonas aeruginosa* strains than a bacteriophage with polynucleotide sequence of SEQ ID NO: 6. In embodiments, provided herein are bacteriophage compositions that include three or more bacteriophages, where the composition includes a bacteriophage with a polynucleotide sequence with at least 90% identity with SEQ ID NO: 6 and the composition targets more *Pseudomonas aeruginosa* strains than a bacteriophage with a polynucleotide sequence with at least 90% identity with SEQ ID NO: 6. In embodiments, the compositions can have any combination polynucleotide sequences of SEQ ID NO: 4, SEQ ID NO: 5, and SEQ ID NO: 6.

In embodiments, the compositions can have any phage with a polynucleotide sequence selected from SEQ ID NO: 1, SEQ ID NO: 2, and SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, and SEQ ID NO: 22.

Provided herein are bacteriophage compositions that include three or more bacteriophages, where the composition includes at least one bacteriophage that is genetically modified. Provided herein are bacteriophage compositions that include two or more bacteriophages, where the composition includes at least one naturally occurring phage. Provided herein are bacteriophage compositions that include two or more bacteriophages, where the composition excludes naturally occurring phage. Provided herein are bacteriophage compositions that include three or more bacteriophages, where the composition excludes naturally occurring phage. Provided herein are bacteriophage compositions that include three or more bacteriophages, where the composition includes one or more bacteriophage that is resistant to inactivation by sputum.

In embodiments, the bacteriophage composition includes an additional component selected from a pharmaceutically acceptable carrier, diluent, excipient and combinations thereof. In embodiments, the bacteriophage composition includes a pharmaceutically acceptable carrier. In embodiments, the bacteriophage composition includes a diluent. In embodiments, the bacteriophage composition includes an excipient. In embodiments, the bacteriophage composition includes a combination of a pharmaceutically acceptable carrier, diluent, and an excipient. In embodiments, the bacteriophage composition includes a combination of a pharmaceutically acceptable carrier and diluent. In embodiments, the bacteriophage composition includes a combination of a pharmaceutically acceptable carrier and an excipient. In embodiments, the bacteriophage composition includes a combination of a diluent and an excipient.

In some embodiments, bacteriophage may be formulated in a dry, respirable powder as a carrier. It can be advantageous if the powder comprises a carbohydrate such as lactose, trehalose or sucrose or any combination thereof. Non-limiting examples of powders that may be used according to the present invention include skim milk powder, soya protein powder, whey protein powder, albumin powder, casein, gelatin, algal protein and other single cell proteins, plant peptone, trehalose, mannitol or other powdered sugar or sugar alcohol, charcoal, or latex beads or other inert surfaces, water-soluble carbohydrate-based materials, talc, chitin, fish cartilage, and the like, or a combination thereof. In the present description, bacteriophages, phage components, or a combination thereof, that are associated with, or adsorbed into a powder, may be referred to as "immobilized phage" or "immobilized bacteriophage". Advantageously, the bacteriophage concentration in the powder is about $1 \times 10^7$ to about $1 \times 10^{11}$ PFU/mg of powder or preferably about $1 \times 10^8$ to about $1 \times 10^{10}$ PFU/mg of powder, although both lower and higher concentrations are also contemplated.

In embodiments, the bacteriophage composition is included in a liquid, semi-liquid, solid, frozen, freeze-dried, cryodesiccated, or lyophilized formulation. In embodiments, the bacteriophage composition is in a liquid formulation. In embodiments, the bacteriophage composition is in a semi-liquid formulation. In embodiments, the bacteriophage composition is in a solid formulation. In embodiments, the bacteriophage composition is in a frozen formulation. In embodiments, the bacteriophage composition is in a lyophilized formulation.

The bacteriophage compositions described herein may be formulated for nasal, parenteral, intramuscular, intraarticular, intravenous, subcutaneous, transdermal, ocular or oral administration. Such a bacteriophage preparation may be used directly, refrigerated, cryodesiccated, lyophilized, stored frozen in aqueous or other solution with an appropriate cryoprotectant, freeze dried and rehydrated prior to use, or rendered stable in some other formulation including, but not limited to, tablet, emulsion, ointment, or impregnated wound dressing or other item. In some embodiments, the cryoprotectant is glycerol, such as between about 5% and about 50% glycerol; more preferably between about 10% and about 30% glycerol; most preferably about 20% glycerol. In other embodiments, the cryoprotectant is sucrose, such as between about 5% to about 30% sucrose, most preferably about 10% sucrose. Suitable concentrations may be any value or subvalue within the recited ranges, including endpoints.

In embodiments, the bacteriophage composition is stored at room temperature. In embodiments, the bacteriophage composition is stored at about 20-30° C. In embodiments, the bacteriophage composition is stored at about 20-25° C. In embodiments, the bacteriophage composition is stored at about 20-22° C. In embodiments, the bacteriophage composition is stored at about 20° C. In embodiments, the bacteriophage composition is stored at about 21° C. In embodiments, the bacteriophage composition is stored at about 22° C. In embodiments, the bacteriophage composition is stored at about 23° C. In embodiments, the bacteriophage composition is stored at about 24° C. In embodiments, the bacteriophage composition is stored at about 25° C. In embodiments, the bacteriophage composition is stored at about 26° C., about 27° C., about 28° C., about 29° C., or about 30° C. The temperature may be any value or subrange within the recited ranges, including endpoints.

In embodiments, the bacteriophage composition includes storage media for storage at a temperature at or below 8° C. In embodiments, the bacteriophage composition includes a storage media for storage at a temperature at or below 7° C. In embodiments, the bacteriophage composition includes a storage media for storage at a temperature at or below 6° C. In embodiments, the bacteriophage composition includes a storage media for storage at a temperature at or below 5° C. In embodiments, the bacteriophage composition includes a storage media for storage at a temperature at or below 4° C. In embodiments, the bacteriophage composition includes a storage media for storage at a temperature at or below 3° C. In embodiments, the bacteriophage composition includes a storage media for storage at a temperature at or below 2° C. In embodiments, the bacteriophage composition includes a storage media for storage at a temperature at or below 1° C. In embodiments, the bacteriophage composition includes a storage media for storage at a temperature at or below 0° C. In embodiments, the bacteriophage composition includes a storage media for storage at a temperature at or below –20° C. In embodiments, the bacteriophage composition includes a storage media for storage at a temperature at or below –80° C.

For embodiments directed to the treatment of a bacterial infection, the bacteriophage composition may be formulated for pulmonary delivery via nasal or oral administration (e.g. by aerosolization or nebulization of the bacteriophage composition). Thus, in one embodiment the bacteriophage composition may be included in a nasal or pulmonary delivery means, such as a spray, a nebulizer, an inhaler or a respirator.

In one aspect, provided herein is a pulmonary delivery means (such as an inhaler, nebulizer, or a respirator) including the bacteriophage composition.

In embodiments, the bacteriophage composition is optimized to prevent titer loss after nebulization or aerosolization and/or to maximize deposition throughout the lung including the lower extremities of the lung. In embodiments, the bacteriophage composition comprises one or more of a dispersing agent, diluent, lubricant, plasticizer, solubilizer, suspending agent, surfactant, viscosity enhancing agent, wetting agent, stabilizer, preservative, aerosolizing agent, osmolarity or osmolality adjusting agent, or a combination thereof.

In embodiments, the bacteriophage composition includes a dispersing agent and/or viscosity modulating agent. Dispersing agents and/or viscosity modulating agents include materials that control the diffusion and homogeneity of a drug through liquid media or a granulation method or blend method. In certain embodiments, these agents also facilitate the effectiveness of a coating or eroding matrix. Examples of diffusion facilitators/dispersing agents include, e.g., hydrophilic polymers, electrolytes, TWEEN®20, TWEEN®60, or TWEEN®80, PEG, Tyloxapol, polyvinylpyrrolidone (PVP; commercially known as Plasdone®), and the carbohydrate-based dispersing agents such as, for example, hydroxypropyl celluloses (e.g., HPC, HPC-SL, and HPC-L), hydroxypropyl methylcelluloses (e.g., HPMC K100, HPMC K4M, HPMC K15M, and HPMC K100M), carboxymethylcellulose sodium, methylcellulose, hydroxyethylcellulose, hydroxypropylcellulose, hydroxypropylmethylcellulose phthalate, hydroxypropylmethylcellulose acetate stearate (HPMCAS), noncrystalline cellulose, magnesium aluminum silicate, triethanolamine, polyvinyl alcohol (PVA), vinyl pyrrolidone/vinyl acetate copolymer (S630), 4-(1,1,3,3-tetramethylbutyl)-phenol polymer with ethylene oxide and formaldehyde (also known as tyloxapol), poloxamers (e.g., Pluronics F68®, F88®, and F108®, which are block copolymers of ethylene oxide and propylene oxide); and poloxamines (e.g., Tetronic 908®, also known as Poloxamine 908®, which is a tetrafunctional block copolymer derived from sequential addition of propylene oxide and ethylene oxide to ethylenediamine (BASF Corporation, Parsippany, N.J.)), polyvinylpyrrolidone K12, polyvinylpyrrolidone K17, polyvinylpyrrolidone K25, or polyvinylpyrrolidone K30, polyvinylpyrrolidone/vinyl acetate copolymer (S-630), polyethylene glycol, e.g., the polyethylene glycol can have a molecular weight of about 300 dalton or greater, sodium carboxymethylcellulose, methylcellulose, polysorbate-80, sodium alginate, gums, such as, e.g., gum tragacanth and gum acacia, guar gum, xanthans, including xanthan gum, sugars, cellulosics, such as, e.g., sodium carboxymethylcellulose, methylcellulose, sodium carboxymethylcellulose, polysorbate-80, sodium alginate, polyethoxylated sorbitan monolaurate, polyethoxylated sorbitan monolaurate, povidone, carbomers, polyvinyl alcohol (PVA), alginates, chitosans and combinations thereof. Plasticizers such as cellulose or triethyl cellulose can also be used as dispersing agents. Dispersing agents particularly useful in liposomal dispersions and self-emulsifying dispersions are dimyristoyl phosphatidylcholine, natural phosphatidyl choline from eggs, natural phosphatidyl glycerol from eggs, cholesterol and isopropyl myristate.

In embodiments, the bacteriophage compositions can be formulated in order to remain in the lung and/or bronchoalveolar lavage fluid up to 24 hours, up to 48 hours, up to 54 hours, up to 60 hours, up to 66 hours, up to 72 hours, up to 78 hours, up to 84 hours, up to 90 hours, or up to 96 hours after administration, for example.

In embodiments, the bacteriophage composition includes diluents. Diluents include chemical compounds that are used to dilute the composition of interest (i.e. individual bacteriophage components or the multi-bacteriophage combination) prior to delivery. Diluents can also be used to stabilize compounds or compositions because they can provide a more stable environment. Salts dissolved in buffered solutions, including, but not limited to, a phosphate buffered saline solution, are utilized as diluents in the art, and can also provide pH control or maintenance. In certain embodiments, diluents increase bulk of the composition to facilitate compression or create sufficient bulk for homogenous blend for capsule filling. Such compounds include e.g., lactose, starch, mannitol, sorbitol, dextrose, microcrystalline cellulose such as Avicel®; dibasic calcium phosphate, dicalcium phosphate dihydrate; tricalcium phosphate, calcium phosphate; anhydrous lactose, spray-dried lactose; pregelatinized starch, compressible sugar, such as Di-Pac® (Amstar); mannitol, hydroxypropylmethylcellulose, hydroxypropylmethylcellulose acetate stearate, sucrose-based diluents, confectioner's sugar; monobasic calcium sulfate monohydrate, calcium sulfate dihydrate; calcium lactate trihydrate, dextrates; hydrolyzed cereal solids, amylose; powdered cellulose, calcium carbonate; glycine, kaolin; mannitol, sodium chloride; inositol, bentonite, and the like.

In embodiments, the bacteriophage composition includes a lubricant or glidant. Lubricants or glidants include compounds that prevent, reduce or inhibit adhesion or friction of materials. Example lubricants include, e.g., stearic acid, calcium hydroxide, talc, sodium stearyl fumerate, a hydrocarbon such as mineral oil, or hydrogenated vegetable oil such as hydrogenated soybean oil (Sterotex®), higher fatty acids and their alkali-metal and alkaline earth metal salts, such as aluminum, calcium, magnesium, zinc, stearic acid, sodium stearates, glycerol, talc, waxes, Stearowet®, boric acid, sodium benzoate, sodium acetate, sodium chloride, leucine, a polyethylene glycol (e.g., PEG-4000) or a methoxypolyethylene glycol such as Carbowax™, sodium oleate, sodium benzoate, glyceryl behenate, polyethylene glycol, magnesium or sodium lauryl sulfate, colloidal silica such as Syloid™, Cab-O-Sil®, a starch such as corn starch, silicone oil, a surfactant, and the like.

In embodiments, the bacteriophage composition includes a plasticizer. Plasticizers include compounds used to soften the microencapsulation material or film coatings to make them less brittle. Suitable plasticizers include, e.g., polyethylene glycols such as PEG 300, PEG 400, PEG 600, PEG 1450, PEG 3350, and PEG 800, stearic acid, propylene glycol, oleic acid, triethyl cellulose and triacetin. In certain embodiments, plasticizers can also function as dispersing agents or wetting agents.

In certain embodiments, a solubilizer includes compounds such as triacetin, triethylcitrate, ethyl oleate, ethyl caprylate, sodium lauryl sulfate, sodium doccusate, vitamin E TPGS, polysorbates (Tweens) dimethylacetamide, N-methylpyrrolidone, N-hydroxyethylpyrrolidone, polyvinylpyrrolidone, hydroxypropylmethyl cellulose, hydroxypropyl cyclodextrins, ethanol, n-butanol, isopropyl alcohol, cholesterol, bile salts, polyethylene glycol 200-600, glycofurol, transcutol, propylene glycol, and dimethyl isosorbide and the like.

In embodiments, the bacteriophage composition includes a stabilizer. Examples of stabilizers include compounds such as any antioxidation agents, e.g., buffers, acids, preservatives and the like.

In embodiments, the bacteriophage composition includes a suspending agent.

Examples of suspending agent include compounds such as polyvinylpyrrolidone, e.g., polyvinylpyrrolidone K12, polyvinylpyrrolidone K17, polyvinylpyrrolidone K25, or polyvinylpyrrolidone K30, vinyl pyrrolidone/vinyl acetate copolymer (S630), polyethylene glycol, e.g., the polyethylene glycol can have a molecular weight of about 300 dalton or greater, sodium carboxymethylcellulose, methylcellulose, hydroxypropylmethylcellulose, hydroxymethylcellulose acetate stearate, polysorbate-80, hydroxyethylcellulose, sodium alginate, gums, such as, e.g., gum tragacanth and gum acacia, guar gum, xanthans, including xanthan gum, sugars, cellulosics, such as, e.g., sodium carboxymethylcellulose, methylcellulose, sodium carboxymethylcellulose, hydroxypropylmethylcellulose, hydroxyethylcellulose, polysorbate-80, sodium alginate, polyethoxylated sorbitan monolaurate, polyethoxylated sorbitan monolaurate, povidone and the like.

In embodiments, the bacteriophage composition includes a surfactant. Examples include compounds such as sodium lauryl sulfate, sodium docusate, TWEEN®20, TWEEN®60, or TWEEN®80, PEG, triacetin, vitamin E TPGS (d-α-Tocopheryl polyethylene glycol 1000 succinate), sorbitan monooleate, polyoxyethylene sorbitan monooleate, polysorbates, polaxomers, bile salts, glyceryl monostearate, copolymers of ethylene oxide and propylene oxide, e.g., Pluronic® (BASF), and the like. Some other surfactants include polyoxyethylene fatty acid glycerides and vegetable oils, e.g., polyoxyethylene (60) hydrogenated castor oil; and polyoxyethylene alkylethers and alkylphenyl ethers, e.g., octoxynol 10, octoxynol 40. In certain embodiments, surfactants may be included to enhance physical stability or for other purposes.

In embodiments, the bacteriophage composition includes a viscosity enhancing agent. Examples include, e.g., methyl cellulose, xanthan gum, carboxymethyl cellulose, hydroxypropyl cellulose, hydroxypropylmethyl cellulose, hydroxypropylmethyl cellulose acetate stearate, hydroxypropylmethyl cellulose phthalate, carbomer, polyvinyl alcohol, alginates, acacia, chitosans, and combinations thereof.

In embodiments, the bacteriophage composition includes a wetting agent. Examples include compounds such as oleic acid, glyceryl monostearate, sorbitan monooleate, sorbitan monolaurate, triethanolamine oleate, polyoxyethylene sorbitan monooleate, polyoxyethylene sorbitan monolaurate, sodium docusate, sodium oleate, sodium lauryl sulfate, sodium doccusate, triacetin, TWEEN©80, vitamin E TPGS, ammonium salts and the like.

In embodiments, the bacteriophage composition includes an aerosolizing agents such as tetrafluoroethane, dydrocarbons, hydrochlorofluorocarbons, hydrofluorocarbons, and compressed gases, compressed air, dimethylether, hydrofluoroalkanes, hydrofluoroolefin, and the like.

In certain embodiments, compositions of the disclosure may comprise an ionic osmolarity or osmolality adjusting agent but, do not comprise a non-ionic osmolarity or osmolality adjusting agent. Ionic osmolarity or osmolality adjusting agents can be selected from, for example, alkali metal salts, such as sodium and potassium salts. Examples of such salts include, but are not limited to, sodium chloride, sodium gluconate, sodium pyruvate, and potassium chloride. It is possible to use a single ionic tonicity-adjusting agent, such as sodium chloride, or a mixture of such agents. The salts may be either added or formed in situ due to a salt formation process. In a particular embodiment of the disclosure, the ionic osmolarity or osmolality adjusting agent is sodium chloride. In embodiments, the osmolarity or osmolality adjusting agent is a non-ionic osmolarity or osmolality adjusting agent and can be selected from, for example, the group of carbohydrates. Examples of carbohydrates that can be used for isotonisation include, but are not limited to, sugars such as glucose, lactose, sucrose and trehalose, and sugar alcohols such as mannitol, xylitol, sorbitol, and isomaltol. In a particular embodiment of the disclosure, however, the non-ionic osmolarity or osmolality adjusting agent is not propylene glycol, a cyclodextrin or mannitol.

It should be appreciated that there is considerable overlap between classes of inactive ingredients. Thus, the above-listed ingredients should be taken as merely exemplary, and not limiting, of the types of inactive ingredients that can be included in formulations described herein. The amounts of such inactive ingredients can be readily determined by one skilled in the art, according to the particular properties desired.

In embodiments, a bacteriophage composition described herein is formulated for nasal irrigation. Thus, a use or method of treatment described herein may include administering a bacteriophage composition to a subject by way of nasal irrigation.

In embodiments, the bacteriophage composition is in a liquid, semi-liquid, solid, frozen, or lyophilized formulation. In embodiments, the bacteriophage composition is in a liquid formulation. In embodiments, the bacteriophage composition is in a semi-liquid formulation. In embodiments, the bacteriophage composition is in a solid formulation. In embodiments, the bacteriophage composition is in a frozen formulation. In embodiments, the bacteriophage composition is in a lyophilized formulation.

In some embodiments (alternatively or additionally), a "mutant" bacteriophage is capable of lysing some or all the same target bacterial strains as one or more of APBP1 (SEQ ID NO: 1), APBP2 (SEQ ID NO: 2) and/or APBP3 (SEQ ID NO: 3), and/or further capable of lysing one or more additional bacterial strains. In one embodiment, a mutant may have at least 93%, 94%, 95%, 96%, 97%, 98%, or 99% sequence identity to a nucleic acid sequence of one or more of APBP1, APBP2, and/or APBP3. In some embodiments, a mutant or variant may have at least 93%, 94%, 95%, 96%, 97%, 98%, or 99% sequence identity across its entire genome sequence when compared to one or more of the genome sequence of APBP1, APBP2 and/or APBP3. In one embodiment, a mutant may have at least 93%, 94%, 95%, 96%, 97%, 98%, or 99% sequence identity across its entire genome sequence when compared to SEQ ID NO: 1. In one embodiment, a mutant may have at least 93%, 94%, 95%, 96%, 97%, 98%, or 99% sequence identity across its entire genome sequence when compared to SEQ ID NO: 2. In one embodiment, a mutant may have at least 93%, 94%, 95%, 96%, 97%, 98%, or 99% sequence identity across its entire genome sequence when compared to SEQ ID NO: 3.

In embodiments, provided are "genetically modified" bacteriophage and compositions of the same. Genetically modified bacteriophages may be a bacteriophages whose polynucleotide sequence has been altered by genetic engineering techniques. Genetic engineering of polynucleotide sequences can be achieved by any modern molecular biology technique well known in the art, including but not limited to homologous recombination, bacteriophage engineering, CRISPR-Cas based manipulation, transformation of full-length naked phage into a host bacteria, and any combinations of techniques thereof.

In embodiments, a bacteriophage progeny is obtainable by contacting one or more bacteriophage(s) described herein, including for example, one selected from APBP1, APBP2, APBP3, or a bacteriophage comprising a nucleic acid sequence selected from SEQ ID NO: 1, SEQ ID NO: 2, SEQ ID NO: 3, SEQ ID NO: 4, SEQ ID NO:5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, and SEQ ID NO: 22 (and sequence identity variants as described herein for any of the same) with a *Pseudomonas aeruginosa* target bacteria such that the one or more bacteriophage(s) infects and lyses the target bacteria; and obtaining a bacteriophage released following lysis of the target bacteria. The bacteriophage progeny will typically comprise one or more nucleotide(s) mutation(s) when compared to the relevant parent bacteriophage.

In embodiments, the bacteriophage may be provided in the form of a single therapeutic composition or as a number of separate compositions each comprising one or more bacteriophage components of the composition. In embodiments where the bacteriophages are provided in a number of separate compositions, the bacteriophages may be administered to a subject sequentially or simultaneously (suitably simultaneously). In some embodiments each separate composition can include a population of one bacteriophages. In other embodiments, one composition can have two or more different phage populations.

In embodiments, the bacteriophage composition includes bacteriophage concentrations between $1 \times 10^4$ and $1 \times 10^{12}$ per ml of each bacteriophage, or any sub value or subrange therein including endpoints. In embodiments, the bacteriophage composition includes bacteriophage concentrations between $1 \times 10^5$ and $1 \times 10^{11}$ per ml of each bacteriophage. In embodiments, the bacteriophage composition includes bacteriophage concentrations between $1 \times 10^6$ and $1 \times 10^{11}$ per ml of each bacteriophage. In embodiments, the bacteriophage composition includes bacteriophage concentrations between $1 \times 10^7$ and $1 \times 10^{11}$ per ml of each bacteriophage. In embodiments, the bacteriophage composition includes bacteriophage concentration range between $1 \times 10^8$ and $1 \times 10^{11}$ per ml of each bacteriophage. In some embodiments, the bacteriophage concentration is $1 \times 10^8$ to $1 \times 10^9$ PFU, $1 \times 10^8$ to $1 \times 10^{10}$ PFU, or $1 \times 10^8$ to $1 \times 10^{11}$ PFU of each phage per ml of composition. In some embodiments, the bacteriophage concentration is $3 \times 10^8$ to $1 \times 10^9$ PFU, $3 \times 10^8$ to $1 \times 10^{10}$ PFU, or $3 \times 10^8$ to $1 \times 10^{11}$ PFU of each phage per ml of composition. In some embodiments, the bacteriophage concentration is $3 \times 10^8$ to $3 \times 10^9$ PFU, or $3 \times 10^8$ to $3 \times 10^{10}$ PFU of each phage per ml of composition. In some embodiments, the bacteriophage concentration is $1 \times 10^9$ to $1 \times 10^{10}$ PFU, or $1 \times 10^9$ to $1 \times 10^{11}$ PFU of each phage per ml of composition. In some embodiments, the bacteriophage concentration is $1 \times 10^{10}$ to $1 \times 10^{11}$ PFU of each phage per ml of composition. In some embodiments, the bacteriophage is administered to a subject at a dosage of at least about $1 \times 10^8$ PFU of each phage, at least about $3 \times 10^8$ PFU of each phage, at least about $1 \times 10^9$ PFU of each phage, at least about $1 \times 10^{10}$ PFU of each phage, or at least about $1 \times 10^{11}$ PFU of each phage per ml of composition. In embodiments, one or more bacteriophage(s) may be combined to form a total concentration of about $1 \times 10^8$, about $3 \times 10^8$, about $1 \times 10^9$, about $1 \times 10^{10}$, or $1 \times 10^{11}$ PFU of each phage per ml of composition. Concentrations include any value, subvalue, range, or subrange within the recited ranges, including endpoints.

In embodiments, the bacteriophage composition is stored at a range between about 2-8° C. In some embodiments, the bacteriophage composition is stored between 2 and 3° C. In some embodiments, the bacteriophage composition is stored between 2 and 4° C. In some embodiments, the bacteriophage composition is stored between 2 and 5° C. In some embodiments, the bacteriophage composition is stored between 2 and 6° C. In some embodiments, the bacteriophage composition is stored between 2 and 7° C. In some embodiments, the bacteriophage composition is stored between 3 and 4° C. In some embodiments, the bacteriophage composition is stored between 3 and 5° C. In some embodiments, the bacteriophage composition is stored between 3 and 6° C. In some embodiments, the bacteriophage composition is stored between 3 and 7° C. In some embodiments, the bacteriophage composition is stored between 3 and 8° C. In some embodiments, the bacteriophage composition is stored between 4 and 5° C. In some embodiments, the bacteriophage composition is stored between 4 and 6° C. In some embodiments, the bacteriophage composition is stored between 4 and 7° C. In some embodiments, the bacteriophage composition is stored between 4 and 8° C. In some embodiments, the bacteriophage composition is stored between 5 and 8° C. In some embodiments, the bacteriophage composition is stored between 5 and 6° C. In some embodiments, the bacteriophage composition is stored between 5 and 7° C. In some embodiments, the bacteriophage composition is stored between 6 and 8° C. In some embodiments, the bacteriophage composition is stored between 6 and 7° C. In some embodiments, the bacteriophage composition is stored between 7 and 8° C. In some embodiments, the bacteriophage composition is stored at about 2, 3, 4, 5, 6, 7, or 8° C. The temperature may be any value or subrange within the recited ranges, including endpoints.

In embodiments, the bacteriophage composition is stored at room temperature. In embodiments, the bacteriophage composition is stored at about 20-25° C. In embodiments, the bacteriophage composition is stored at 20° C. In embodiments, the bacteriophage composition is stored at about 21° C. In embodiments, the bacteriophage composition is stored at about 22° C. In embodiments, the bacteriophage composition is stored at about 23° C. In embodiments, the bacteriophage composition is stored at about 24° C. In embodiments, the bacteriophage composition is stored at about 25° C. The temperature may be any value or subrange within the recited ranges, including endpoints.

In embodiments, the bacteriophage composition is stored at freezing temperatures, such as at any temperature ranging from about −25° C. to about −5° C. This includes, but is not necessarily limited to, about −30° C., −29° C., −28° C., −27° C., −26° C., −25° C., −24° C., −23° C., −22° C., −21° C., −20° C., −19° C., −18° C., −17° C., −16° C., −15° C., −15° C., −14° C., −13° C., −12° C., −11° C., −10° C., −9° C., −8° C., −7° C., −6° C., or −5° C. or any value or subrange within the recited ranges, including endpoints.

In embodiments, the bacteriophage composition is resistant to inactivation by the immune system of a subject. In some embodiments, the bacteriophage is resistant to inactivation by the innate immune system of a subject. In some embodiments, the bacteriophage is resistant to inactivation by the sputum of a subject. In some embodiments, the bacteriophage is resistant to inactivation by the bronchoalveolar lavage fluid (BALF) of a subject.

In embodiments, the bacteriophage composition reduces biofilm mass, as described in more detail in the examples.

In embodiments, the bacteriophage composition includes at least one lytic bacteriophage. In some embodiments, the bacteriophage includes at least one lytic phage that can kill a bacteria via cell lysis.

In an aspect, provided herein is a bacterial host manufacturing strain including a bacteriophage where the bacteriophage includes a polynucleotide sequence selected from SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, a polynucleotide sequence with at least 93% identity to SEQ ID NO: 1, a polynucleotide sequence with at least 93% identity to SEQ ID NO: 2, a polynucleotide sequence with at least 93% identity to SEQ ID NO: 3, a polynucleotide sequence with at least 93% identity to SEQ ID NO: 4, a polynucleotide sequence with at least 93% identity to SEQ ID NO: 5, and a polynucleotide sequence with at least 93% identity to SEQ ID NO: 6, a polynucleotide sequence with at least 93% identity to SEQ ID NO: 7, a polynucleotide sequence with at least 93% identity to SEQ ID NO: 8, a polynucleotide sequence with at least 93% identity to SEQ ID NO: 9, a polynucleotide sequence with at least 89% identity to SEQ ID NO: 10, a polynucleotide sequence with at least 95% identity to SEQ ID NO: 11, a polynucleotide sequence with at least 91% identity to SEQ ID NO: 12, a polynucleotide sequence with at least 92% identity to SEQ ID NO: 13, a polynucleotide sequence with at least 96% identity to SEQ ID NO: 14, a polynucleotide sequence with at least 95% identity to SEQ ID NO: 15, a polynucleotide sequence with at least 90% identity to SEQ ID NO: 16, a polynucleotide sequence with at least 92% identity to SEQ ID NO: 17, a polynucleotide sequence with at least 95% identity to SEQ ID NO: 18, a polynucleotide sequence with at least 96% identity to SEQ ID NO: 19, a polynucleotide sequence with at least 96% identity to SEQ ID NO: 20, a polynucleotide sequence with at least 96% identity to SEQ ID NO: 21, a polynucleotide sequence with at least 95% identity to SEQ ID NO: 22.

In an aspect, provided herein is a bacterial host manufacturing strain including a bacteriophage where the bacteriophage includes a polynucleotide sequence selected from SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, and SEQ ID NO: 22, a polynucleotide sequence with at least 90% identity to SEQ ID NO: 1, a polynucleotide sequence with at least 90% identity to SEQ ID NO: 2, a polynucleotide sequence with at least 90% identity to SEQ ID NO: 3, a polynucleotide sequence with at least 90% identity to SEQ ID NO: 4, a polynucleotide sequence with at least 90% identity to SEQ ID NO: 5, a polynucleotide sequence with at least 90% identity to SEQ ID NO: 6, a polynucleotide sequence with at least 93% identity to SEQ ID NO: 7, a polynucleotide sequence with at least 93% identity to SEQ ID NO: 8, a polynucleotide sequence with at least 93% identity to SEQ ID NO: 9, a polynucleotide sequence with at least 89% identity to SEQ ID NO: 10, a polynucleotide sequence with at least 95% identity to SEQ ID NO: 11, a polynucleotide sequence with at least 91% identity to SEQ ID NO: 12, a polynucleotide sequence with at least 92% identity to SEQ ID NO: 13, a polynucleotide sequence with at least 96% identity to SEQ ID NO: 14, a polynucleotide sequence with at least 95% identity to SEQ ID NO: 15, a polynucleotide sequence with at least 90% identity to SEQ ID NO: 16, a polynucleotide sequence with at least 92% identity to SEQ ID NO: 17, a polynucleotide sequence with at least 95% identity to SEQ ID NO: 18, a polynucleotide sequence with at least 96% identity to SEQ ID NO: 19, a polynucleotide sequence with at least 96% identity to SEQ ID NO: 20, a polynucleotide sequence with at least 96% identity to SEQ ID NO: 21, a polynucleotide sequence with at least 95% identity to SEQ ID NO: 22.

In embodiments, provided herein is a bacterial host manufacturing strain including a bacteriophage that includes a polynucleotide sequence of SEQ ID NO: 1. In embodiments, provided herein is a bacterial host manufacturing strain including a bacteriophage that includes a polynucleotide sequence of SEQ ID NO: 2. In embodiments, provided herein is a bacterial host manufacturing strain including a bacteriophage that includes a polynucleotide sequence of SEQ ID NO: 3. In embodiments, provided herein is a bacterial host manufacturing strain including a bacteriophage that includes a polynucleotide sequence of SEQ ID NO: 4. In embodiments, provided herein is a bacterial host manufacturing strain including a bacteriophage that includes a polynucleotide sequence of SEQ ID NO: 5. In embodiments, provided herein is a bacterial host manufacturing strain including a bacteriophage that includes a polynucleotide sequence of SEQ ID NO: 6. In embodiments, provided herein is a bacterial host manufacturing strain including a bacteriophage that includes a polynucleotide sequence of with at least 90% identity to SEQ ID NO: 1. In embodiments, provided herein is a bacterial host manufacturing strain including a bacteriophage that includes a polynucleotide sequence of polynucleotide sequence with at least 90% identity to SEQ ID NO: 2. In embodiments, provided herein is a bacterial host manufacturing strain including a bacteriophage that includes a polynucleotide sequence of polynucleotide sequence with at least 90% identity to SEQ ID NO: 3. In embodiments, provided herein is a bacterial host manufacturing strain including a bacteriophage that includes a polynucleotide sequence of with at least 90% identity to SEQ ID NO: 4. In embodiments, provided herein is a bacterial host manufacturing strain including a bacteriophage that includes a polynucleotide sequence of with at least 90% identity to SEQ ID NO: 5. In embodiments, provided herein is a bacterial host manufacturing strain including a bacteriophage that includes a polynucleotide sequence of with at least 90% identity to SEQ ID NO: 6. In embodiments, provided herein is a bacterial host manufacturing strain including a bacteriophage according to any of the various embodiments described herein.

Variants of the phages described herein are contemplated that may have anywhere between 85% and 99.99% identity to the phages described herein. The percent identity may be any value or subrange within the recited ranges to the $100^{th}$ place after the decimal.

Methods of Use

In embodiments, provided herein are uses of a phage and/or composition according to any of the various embodiments described herein in the treatment of a bacterial infection, particularly a *Pseudomonas aeruginosa* infection in a subject. In embodiments, the use includes administering a composition according to any of the embodiments described herein to a subject suffering from a *Pseudomonas aeruginosa* infection.

In embodiments, provided herein are uses of a composition including one or more distinct bacteriophages that target *Pseudomonas aeruginosa* in the treatment of subject with a *Pseudomonas aeruginosa* bacterial infection. The uses include administering the composition to said subject; wherein at least one of the bacteriophages is selected from a bacteriophage comprising a polynucleotide sequence of SEQ ID NO: 1, SEQ ID NO: 2, SEQ ID NO: 3, a polynucleotide sequence with at least 93% identity to SEQ ID NO: 1, a polynucleotide sequence with at least 93% identity to SEQ ID NO: 2, and a polynucleotide sequence with at least 93% identity to SEQ ID NO: 3.

In embodiments, provided herein are uses of a composition including one or more distinct bacteriophages that target *Pseudomonas aeruginosa* in the treatment of subject with a *Pseudomonas aeruginosa* bacterial infection. The uses include administering the composition to said subject; wherein at least one of the bacteriophages is selected from a bacteriophage comprising a polynucleotide sequence of SEQ ID NO: 1, SEQ ID NO: 2, SEQ ID NO: 3, a polynucleotide sequence with at least 85% identity to SEQ ID NO: 1, a polynucleotide sequence with at least 85% identity to SEQ ID NO: 2, and a polynucleotide sequence with at least 85% identity to SEQ ID NO: 3.

In embodiments, provided herein are uses of a composition including one or more distinct bacteriophages that target *Pseudomonas aeruginosa* in the treatment of subject with a *Pseudomonas aeruginosa* bacterial infection. The uses include administering the composition to said subject; wherein at least one of the bacteriophages is selected from a bacteriophage comprising a polynucleotide sequence of SEQ ID NO: 1, SEQ ID NO: 2, SEQ ID NO: 3, a polynucleotide sequence with at least 93% identity to SEQ ID NO: 1, a polynucleotide sequence with at least 93% identity to SEQ ID NO: 2, and a polynucleotide sequence with at least 93% identity to SEQ ID NO: 3; and in addition, at least one of the bacteriophages is selected from a bacteriophage comprising a polynucleotide sequence of SEQ ID NO: 4, SEQ ID NO: 5, SEQ ID NO: 6, a polynucleotide sequence with at least 93% identity to SEQ ID NO: 4, a polynucleotide sequence with at least 93% identity to SEQ ID NO: 5, and a polynucleotide sequence with at least 93% identity to SEQ ID NO: 6.

In embodiments, provided herein are uses of a composition including one or more distinct bacteriophages that target *Pseudomonas aeruginosa* in the treatment of subject with a *Pseudomonas aeruginosa* bacterial infection. The uses include administering the composition to said subject; wherein at least one of the bacteriophages is selected from a bacteriophage comprising a polynucleotide sequence of SEQ ID NO: 1, SEQ ID NO: 2, SEQ ID NO: 3, a polynucleotide sequence with at least 85% identity to SEQ ID NO: 1, a polynucleotide sequence with at least 85% identity to SEQ ID NO: 2, and a polynucleotide sequence with at least 85% identity to SEQ ID NO: 3; and in addition, at least one of the bacteriophages is selected from a bacteriophage comprising a polynucleotide sequence of SEQ ID NO: 4, SEQ ID NO: 5, SEQ ID NO: 6, a polynucleotide sequence with at least 85% identity to SEQ ID NO: 4, a polynucleotide sequence with at least 85% identity to SEQ ID NO: 5, and a polynucleotide sequence with at least 85% identity to SEQ ID NO: 6.

In an aspect, provided herein are methods of treating a subject with a bacterial infection including selecting a bacteriophage based upon resistance to sputum inactivation and administering the bacteriophage to the subject.

In an aspect, provided herein are methods of treating a subject with a bacterial infection including administering to the subject one or more distinct bacteriophages selected from a bacteriophage including a polynucleotide sequence selected from SEQ ID NO: 1, SEQ ID NO: 2, SEQ ID NO: 3, SEQ ID NO: 4, SEQ ID NO: 5, SEQ ID NO: 6, a polynucleotide sequence with at least 93% identity to SEQ ID NO: 1, a polynucleotide sequence with at least 93% identity to SEQ ID NO: 2, and a polynucleotide sequence with at least 93% identity to SEQ ID NO: 3. a polynucleotide sequence with at least 93% identity to SEQ ID NO: 4, a polynucleotide sequence with at least 93% identity to SEQ ID NO: 5, a polynucleotide sequence with at least 93% identity to SEQ ID NO: 6. In an aspect, provided herein are methods of treating a subject with a bacterial infection including administering to the subject one or more distinct bacteriophages as described in any embodiment herein.

In an aspect, provided herein are methods of treating a subject with a bacterial infection including administering to the subject one or more distinct bacteriophages selected from a bacteriophage including a polynucleotide sequence selected from SEQ ID NO: 1, SEQ ID NO: 2, SEQ ID NO: 3, SEQ ID NO: 4, SEQ ID NO: 5, SEQ ID NO: 6, a polynucleotide sequence with at least 85% identity to SEQ ID NO: 1, a polynucleotide sequence with at least 85% identity to SEQ ID NO: 2, and a polynucleotide sequence with at least 85% identity to SEQ ID NO: 3. a polynucleotide sequence with at least 85% identity to SEQ ID NO: 4, a polynucleotide sequence with at least 85% identity to SEQ ID NO: 5, a polynucleotide sequence with at least 85% identity to SEQ ID NO: 6. In an aspect, provided herein are methods of treating a subject with a bacterial infection including administering to the subject one or more distinct bacteriophages as described in any embodiment herein.

In an aspect, provided herein are methods of treating a subject with a bacterial infection including administering to the subject one or more distinct bacteriophages selected from a bacteriophage comprising a polynucleotide sequence selected from SEQ ID NO: 1, SEQ ID NO: 2, SEQ ID NO: 3, a polynucleotide sequence with at least 85% identity to SEQ ID NO: 1, a polynucleotide sequence with at least 85% identity to SEQ ID NO: 2, and a polynucleotide sequence with at least 85% identity to SEQ ID NO: 3.

In another aspect, provided herein are methods of treating a subject with a bacterial infection including administering to the subject one or more distinct bacteriophages selected from a bacteriophage comprising a polynucleotide sequence selected from SEQ ID NO: 4, SEQ ID NO: 5, SEQ ID NO: 6, a polynucleotide sequence with at least 85% identity to SEQ ID NO: 4, a polynucleotide sequence with at least 85% identity to SEQ ID NO: 5, and a polynucleotide sequence with at least 85% identity to SEQ ID NO: 6.

In embodiments, provided herein are methods of treating a subject with a bacterial infection including administering to the subject one or more distinct bacteriophages selected from a bacteriophage comprising a polynucleotide sequence selected from SEQ ID NO: 1, SEQ ID NO: 2 and SEQ ID NO: 3. In embodiments, provided herein are methods of treating a subject with a bacterial infection including administering to the subject one or more distinct bacteriophages selected from a bacteriophage comprising a polynucleotide sequence with at least 93% identity to SEQ ID NO: 1, a polynucleotide sequence with at least 93% identity to SEQ ID NO: 2, and a polynucleotide sequence with at least 93% identity to SEQ ID NO: 3

In embodiments, provided herein are methods of treating a subject with a bacterial infection including administering to the subject one or more distinct bacteriophages selected from a bacteriophage comprising a polynucleotide sequence selected from SEQ ID NO: 1, SEQ ID NO: 2 and SEQ ID NO: 3. In embodiments, provided herein are methods of treating a subject with a bacterial infection including administering to the subject one or more distinct bacteriophages selected from a bacteriophage comprising a polynucleotide sequence with at least 85% identity to SEQ ID NO: 1, a polynucleotide sequence with at least 85% identity to SEQ ID NO: 2, and a polynucleotide sequence with at least 85% identity to SEQ ID NO: 3.

In an aspect, a method of treating a subject with a bacterial infection including administering to the subject one or more distinct bacteriophages selected from a bacteriophage comprising a polynucleotide sequence selected from SEQ ID NO: 1, SEQ ID NO: 2, SEQ ID NO: 3, a polynucleotide sequence with at least 93% identity to SEQ ID NO: 1, a polynucleotide sequence with at least 93% identity to SEQ ID NO: 2, and a polynucleotide sequence with at least 93% identity to SEQ ID NO: 3; and in addition, one or more distinct bacteriophages selected from a bacteriophage comprising a polynucleotide sequence selected from SEQ ID NO: 4, SEQ ID NO: 5, SEQ ID NO: 6, a polynucleotide sequence with at least 93% identity to SEQ ID NO: 4, a polynucleotide sequence with at least 93% identity to SEQ ID NO: 5, and a polynucleotide sequence with at least 93% identity to SEQ ID NO: 6.

In an aspect, a method of treating a subject with a bacterial infection including administering to the subject one or more distinct bacteriophages selected from a bacteriophage comprising a polynucleotide sequence selected from SEQ ID NO: 1, SEQ ID NO: 2, SEQ ID NO: 3, a polynucleotide sequence with at least 85% identity to SEQ ID NO: 1, a polynucleotide sequence with at least 85% identity to SEQ ID NO: 2, and a polynucleotide sequence with at least 85% identity to SEQ ID NO: 3; and in addition, one or more distinct bacteriophages selected from a bacteriophage comprising a polynucleotide sequence selected from SEQ ID NO: 4, SEQ ID NO: 5, SEQ ID NO: 6, a polynucleotide sequence with at least 85% identity to SEQ ID NO: 4, a polynucleotide sequence with at least 85% identity to SEQ ID NO: 5, and a polynucleotide sequence with at least 85% identity to SEQ ID NO: 6.

In embodiments, provided herein are methods of treating a subject with a bacterial infection. In some embodiments, the bacterial infection at least partially includes *Pseudomonas*. In some embodiments, the bacterial infection at least partially includes *Pseudomonas aeruginosa*. In some embodiments, the bacterial infection includes *Pseudomonas aeruginosa* strains resistant to chemical antibiotics. In some embodiments, the bacterial strains include drug resistant and/or multi-drug resistant *Pseudomonas aeruginosa* strains.

In embodiments, provided herein are methods of treating a subject with a bacterial infection including administering to a subject a bacteriophage that is resistant to inactivation in the sputum. In embodiments, provided herein are methods of treating a subject with a bacterial infection including administering to a subject a bacteriophage that is resistant to inactivation by innate immune system. In embodiments, provided herein are methods of treating a subject with a bacterial infection including administering to a subject a bacteriophage that is resistant to inactivation by plasma. In embodiments, the bacteriophage can be any bacteriophage as described herein.

In embodiments, provided herein are methods of treating a subject with a bacterial infection including administering to a subject a bacteriophage that includes a polynucleotide sequence of SEQ ID NO: 1. In embodiments, provided herein are methods of treating a subject with a bacterial infection including administering to a subject a bacteriophage that includes a polynucleotide sequence of SEQ ID NO: 2. In embodiments, provided herein are methods of treating a subject with a bacterial infection including administering to a subject a bacteriophage that includes a polynucleotide sequence of SEQ ID NO: 3. In embodiments, provided herein are methods of treating a subject with a bacterial infection including administering to a subject a bacteriophage that includes a polynucleotide sequence of SEQ ID NO: 4. In embodiments, provided herein are methods of treating a subject with a bacterial infection including administering to a subject a bacteriophage that includes a polynucleotide sequence of SEQ ID NO: 5. In embodiments, provided herein are methods of treating a subject with a bacterial infection including administering to a subject a bacteriophage that includes a polynucleotide sequence of SEQ ID NO: 6. In embodiments, provided herein are methods of treating a subject with a bacterial infection including administering to a subject a bacteriophage that includes a polynucleotide sequence with at least 93% identity to a SEQ ID NO: 1. In embodiments, provided herein are methods of treating a subject with a bacterial infection including administering to a subject a bacteriophage that includes a polynucleotide sequence with at least 93% identity to SEQ ID NO: 2. In embodiments, provided herein are methods of treating a subject with a bacterial infection including administering to a subject a bacteriophage that includes a polynucleotide sequence with at least 93% identity to SEQ ID NO: 3. In embodiments, provided herein are methods of treating a subject with a bacterial infection including administering to a subject a bacteriophage that includes a polynucleotide sequence with at least 93% identity to SEQ ID NO: 4. In embodiments, provided herein are methods of treating a subject with a bacterial infection including administering to a subject a bacteriophage that includes a polynucleotide sequence with at least 93% identity to SEQ ID NO: 5. In embodiments, provided herein are methods of treating a subject with a bacterial infection including administering to a subject a bacteriophage that includes a polynucleotide sequence with at least 93% identity to SEQ ID NO: 6. In embodiments, provided herein are methods of treating a subject with a bacterial infection including administering to a subject a bacteriophage that includes a polynucleotide sequence with at least 85% identity to a SEQ ID NO: 1. In embodiments, provided herein are methods of treating a subject with a bacterial infection including administering to a subject a bacteriophage that includes a polynucleotide sequence with at least 85% identity to SEQ ID NO: 2. In embodiments, provided herein are methods of treating a subject with a bacterial infection including administering to a subject a bacteriophage that includes a polynucleotide sequence with at least 85% identity to SEQ ID NO: 3. In embodiments, provided herein are methods of treating a subject with a bacterial infection including administering to a subject a bacteriophage that includes a polynucleotide sequence with at least 85% identity to SEQ ID NO: 4. In embodiments, provided herein are methods of treating a subject with a bacterial infection including administering to a subject a bacteriophage that includes a polynucleotide sequence with at least 85% identity to SEQ ID NO: 5. In embodiments, provided herein are methods of treating a subject with a bacterial infection including administering to a subject a bacteriophage that includes a polynucleotide sequence with at least 85% identity to SEQ ID NO: 6.

In embodiments, provided herein are methods of treating a subject with a bacterial infection including administering to a subject a bacteriophage that infects and kills *Pseudomonas, Pseudomonas aeruginosa*, single-drug resistant *Pseudomonas aeruginosa*, and multi-drug resistant *Pseudomonas aeruginosa*. In embodiments, provided herein are methods of treating a subject with a bacterial infection including administering to a subject a bacteriophage that infects and kills *Pseudomonas* aeruginosa.

In embodiments, provided herein are methods of treating a subject with a bacterial infection including administering to a subject one or more bacteriophages. In embodiments, the one or more bacteriophages are suitable for treating a bacterial infection, in particular a *Pseudomonas* infection. In embodiments, the bacteriophage includes one or more additional phages and can be a phage with 85% to 100% nucleic acid sequence identity to any of the phage described herein. The bacteriophage can have a polynucleotide sequence, which includes a polynucleotide sequence having at least 85% but not 100% identity to any one of SEQ ID NO: 1, SEQ ID NO: 2, SEQ ID NO: 3, SEQ ID NO: 4, SEQ ID NO: 5, and SEQ ID NO: 6. Percent identity may be any value or subrange within the recited ranges, including endpoints.

In embodiments, provided herein are methods of treating a subject with a bacterial infection including administering to a subject a bacteriophage composition that includes one or more bacteriophages and the composition's target bacteria range can be broader than the range of any individual bacteriophage or the phage collectively in the composition, or have an effectiveness that is greater than the sum of effectiveness of the individual bacteriophage. In embodiments, provided herein are methods of treating a subject with a bacterial infection including administering to a subject a bacteriophage composition that includes a bacteriophage with polynucleotide sequence SEQ ID NO: 1. In embodiments, provided herein are methods of treating a subject with a bacterial infection including administering to a subject a bacteriophage composition that includes a bacteriophage with a polynucleotide sequence at least 85% identity with SEQ ID NO: 1. In embodiments, provided herein are methods of treating a subject with a bacterial infection including administering to a subject a bacteriophage composition that includes a bacteriophage with a polynucleotide sequence at least 86% identity with SEQ ID NO: 1. In embodiments, provided herein are methods of treating a subject with a bacterial infection including administering to a subject a bacteriophage composition that includes a bacteriophage with a polynucleotide sequence at least 87% identity with SEQ ID NO: 1. In embodiments, provided herein are methods of treating a subject with a bacterial infection including administering to a subject a bacteriophage composition that includes a bacteriophage with a polynucleotide sequence at least 88% identity with SEQ ID NO: 1. In embodiments, provided herein are methods of treating a subject with a bacterial infection including administering to a subject a bacteriophage composition that includes a bacteriophage with a polynucleotide sequence at least 89% identity with SEQ ID NO: 1. In embodiments, provided herein are methods of treating a subject with a bacterial infection including administering to a subject a bacteriophage composition that includes a bacteriophage with a polynucleotide sequence at least 90% identity with SEQ ID NO: 1. In embodiments, provided herein are methods of treating a subject with a bacterial infection including administering to a subject a bacteriophage composition that includes a bacteriophage with a polynucleotide sequence at least 91% identity with SEQ ID NO: 1. In embodiments, provided herein are methods of treating a subject with a bacterial infection including administering to a subject a bacteriophage composition that includes a bacteriophage with a polynucleotide sequence at least 92% identity with SEQ ID NO: 1. In embodiments, provided herein are methods of treating a subject with a bacterial infection including administering to a subject a bacteriophage composition that includes a bacteriophage with a polynucleotide sequence at least 93% identity with SEQ ID NO: 1. In embodiments, provided herein are methods of treating a subject with a bacterial infection including administering to a subject a bacteriophage composition that includes a bacteriophage with a polynucleotide sequence at least 94% identity with SEQ ID NO: 1. In embodiments, provided herein are methods of treating a subject with a bacterial infection including administering to a subject a bacteriophage composition that includes a bacteriophage with a polynucleotide sequence at least 95% identity with SEQ ID NO: 1. In embodiments, provided herein are methods of treating a subject with a bacterial infection including administering to a subject a bacteriophage composition that includes a bacteriophage with a polynucleotide sequence at least 96% identity with SEQ ID NO: 1. In embodiments, provided herein are methods of treating a subject with a bacterial infection including administering to a subject a bacteriophage composition that includes a bacteriophage with a polynucleotide sequence at least 97% identity with SEQ ID NO: 1. In embodiments, provided herein are methods of treating a subject with a bacterial infection including administering to a subject a bacteriophage composition that includes a bacteriophage with a polynucleotide sequence at least 98% identity with SEQ ID NO: 1. In embodiments, provided herein are methods of treating a subject with a bacterial infection including administering to a subject a bacteriophage composition that includes a bacteriophage with a polynucleotide sequence at least 99% identity with SEQ ID NO: 1.

In embodiments, provided herein are methods of treating a subject with a bacterial infection including administering to a subject a bacteriophage composition that includes a bacteriophage with polynucleotide sequence SEQ ID NO: 2. In embodiments, provided herein are methods of treating a subject with a bacterial infection including administering to a subject a bacteriophage composition that includes a bacteriophage with a polynucleotide sequence at least 85% identity with SEQ ID NO: 2. In embodiments, provided herein are methods of treating a subject with a bacterial infection including administering to a subject a bacteriophage composition that includes a bacteriophage with a polynucleotide sequence at least 86% identity with SEQ ID NO: 2. In embodiments, provided herein are methods of treating a subject with a bacterial infection including administering to a subject a bacteriophage composition that includes a bacteriophage with a polynucleotide sequence at least 87% identity with SEQ ID NO: 2. In embodiments, provided herein are methods of treating a subject with a bacterial infection including administering to a subject a bacteriophage composition that includes a bacteriophage with a polynucleotide sequence at least 88% identity with SEQ ID NO: 2. In embodiments, provided herein are methods of treating a subject with a bacterial infection including administering to a subject a bacteriophage composition that includes a bacteriophage with a polynucleotide sequence at least 89% identity with SEQ ID NO: 2. In embodiments, provided herein are methods of treating a subject with a bacterial infection including administering to a subject a bacteriophage composition that includes a bacteriophage with a polynucleotide sequence at least 90% identity with SEQ ID NO: 2. In embodiments, provided herein are methods of treating a subject with a bacterial infection including administering to a subject a bacteriophage composition that includes a bacteriophage with a polynucleotide sequence at least 91% identity with SEQ ID NO: 2. In embodiments, provided herein are methods of treating a subject with a bacterial infection including administering to a subject a bacteriophage composition that includes a bacteriophage with a polynucleotide sequence at least 92% identity with SEQ ID NO: 2. In embodiments, provided herein are methods of treating a subject with a bacterial infection including administering to a subject a bacteriophage composition that includes a bacteriophage with a polynucleotide sequence at least 93% identity with SEQ ID NO: 2. I In embodiments, provided herein are methods of treating a subject with a bacterial infection including administering to a subject a bacteriophage composition that includes a bacteriophage with a polynucleotide sequence at least 94% identity with SEQ ID NO: 2. In embodiments, provided herein are methods of treating a subject with a bacterial infection including administering to a subject a bacteriophage composition that includes a bacteriophage with a polynucleotide sequence at least 95% identity with SEQ ID NO: 2. In embodiments, provided herein are methods of treating a subject with a bacterial infection including administering to a subject a bacteriophage composition that includes a bacteriophage with a polynucleotide sequence at least 96% identity with SEQ ID NO: 2. In embodiments, provided herein are methods of treating a subject with a bacterial infection including administering to a subject a bacteriophage composition that includes a bacteriophage with a polynucleotide sequence at least 97% identity with SEQ ID NO: 2. In embodiments, provided herein are methods of treating a subject with a bacterial infection including administering to a subject a bacteriophage composition that includes a bacteriophage with a polynucleotide sequence at least 98% identity with SEQ ID NO: 2. In embodiments, provided herein are methods of treating a subject with a bacterial infection including administering to a subject a bacteriophage composition that includes a bacteriophage with a polynucleotide sequence at least 99% identity with SEQ ID NO: 2. In embodiments, provided herein are methods of treating a subject with a bacterial infection including administering to a subject a bacteriophage composition that have any combination polynucleotide sequences of SEQ ID NO: 1 and SEQ ID NO: 2.

In embodiments, provided herein are methods of treating a subject with a bacterial infection including administering to a subject a bacteriophage composition that includes a bacteriophage with polynucleotide sequence SEQ ID NO: 3. In embodiments, provided herein are methods of treating a subject with a bacterial infection including administering to a subject a bacteriophage composition that includes a bacteriophage with a polynucleotide sequence at least 85% identity with SEQ ID NO: 3. In embodiments, provided herein are methods of treating a subject with a bacterial infection including administering to a subject a bacteriophage composition that includes a bacteriophage with a polynucleotide sequence at least 86% identity with SEQ ID NO: 3. In embodiments, provided herein are methods of treating a subject with a bacterial infection including administering to a subject a bacteriophage composition that includes a bacteriophage with a polynucleotide sequence at least 87% identity with SEQ ID NO: 3. In embodiments, provided herein are methods of treating a subject with a bacterial infection including administering to a subject a bacteriophage composition that includes a bacteriophage with a polynucleotide sequence at least 88% identity with SEQ ID NO: 3. In embodiments, provided herein are methods of treating a subject with a bacterial infection including administering to a subject a bacteriophage composition that includes a bacteriophage with a polynucleotide sequence at least 89% identity with SEQ ID NO: 3. In embodiments, provided herein are methods of treating a subject with a bacterial infection including administering to a subject a bacteriophage composition that includes a bacteriophage with a polynucleotide sequence at least 90% identity with SEQ ID NO: 3. In embodiments, provided herein are methods of treating a subject with a bacterial infection including administering to a subject a bacteriophage composition that includes a bacteriophage with a polynucleotide sequence at least 91% identity with SEQ ID NO: 3. In embodiments, provided herein are methods of treating a subject with a bacterial infection including administering to a subject a bacteriophage composition that includes a bacteriophage with a polynucleotide sequence at least 92% identity with SEQ ID NO: 3. In embodiments, provided herein are methods of treating a subject with a bacterial infection including administering to a subject a bacteriophage composition that includes a bacteriophage with a polynucleotide sequence at least 93% identity with SEQ ID NO: 3. I In embodiments, provided herein are methods of treating a subject with a bacterial infection including administering to a subject a bacteriophage composition that includes a bacteriophage with a polynucleotide sequence at least 94% identity with SEQ ID NO: 3. In embodiments, provided herein are methods of treating a subject with a bacterial infection including administering to a subject a bacteriophage composition that includes a bacteriophage with a polynucleotide sequence at least 95% identity with SEQ ID NO: 3. In embodiments, provided herein are methods of treating a subject with a bacterial infection including administering to a subject a bacteriophage composition that includes a bacteriophage with a polynucleotide sequence at least 96% identity with SEQ ID NO: 3. In embodiments, provided herein are methods of treating a subject with a bacterial infection including administering to a subject a bacteriophage composition that includes a bacteriophage with a polynucleotide sequence at least 97% identity with SEQ ID NO: 3. In embodiments, provided herein are methods of treating a subject with a bacterial infection including administering to a subject a bacteriophage composition that includes a bacteriophage with a polynucleotide sequence at least 98% identity with SEQ ID NO: 3. In embodiments, provided herein are methods of treating a subject with a bacterial infection including administering to a subject a bacteriophage composition that includes a bacteriophage with a polynucleotide sequence at least 99% identity with SEQ ID NO: 3.

In embodiments, provided herein are methods of treating a subject with a bacterial infection including administering to a subject a bacteriophage composition that includes a bacteriophage with polynucleotide sequence SEQ ID NO: 4. In embodiments, provided herein are methods of treating a subject with a bacterial infection including administering to a subject a bacteriophage composition that includes a bacteriophage with a polynucleotide sequence at least 85% identity with SEQ ID NO: 4. In embodiments, provided herein are methods of treating a subject with a bacterial infection including administering to a subject a bacteriophage composition that includes a bacteriophage with a polynucleotide sequence at least 86% identity with SEQ ID NO: 4. In embodiments, provided herein are methods of treating a subject with a bacterial infection including administering to a subject a bacteriophage composition that includes a bacteriophage with a polynucleotide sequence at least 87% identity with SEQ ID NO: 4. In embodiments, provided herein are methods of treating a subject with a bacterial infection including administering to a subject a bacteriophage composition that includes a bacteriophage with a polynucleotide sequence at least 88% identity with SEQ ID NO: 4. In embodiments, provided herein are methods of treating a subject with a bacterial infection including administering to a subject a bacteriophage composition that includes a bacteriophage with a polynucleotide sequence at least 89% identity with SEQ ID NO: 4. In embodiments, provided herein are methods of treating a subject with a bacterial infection including administering to a subject a bacteriophage composition that includes a bacteriophage with a polynucleotide sequence at least 90% identity with SEQ ID NO: 4. In embodiments, provided herein are methods of treating a subject with a bacterial infection including administering to a subject a bacteriophage composition that includes a bacteriophage with a polynucleotide sequence at least 91% identity with SEQ ID NO: 4. In embodiments, provided herein are methods of treating a subject with a bacterial infection including administering to a subject a bacteriophage composition that includes a bacteriophage with a polynucleotide sequence at least 92% identity with SEQ ID NO: 4. In embodiments, provided herein are methods of treating a subject with a bacterial infection including administering to a subject a bacteriophage composition that includes a bacteriophage with a polynucleotide sequence at least 93% identity with SEQ ID NO: 4. I In embodiments, provided herein are methods of treating a subject with a bacterial infection including administering to a subject a bacteriophage composition that includes a bacteriophage with a polynucleotide sequence at least 94% identity with SEQ ID NO: 4. In embodiments, provided herein are methods of treating a subject with a bacterial infection including administering to a subject a bacteriophage composition that includes a bacteriophage with a polynucleotide sequence at least 95% identity with SEQ ID NO: 4. In embodiments, provided herein are methods of treating a subject with a bacterial infection including administering to a subject a bacteriophage composition that includes a bacteriophage with a polynucleotide sequence at least 96% identity with SEQ ID NO: 4. In embodiments, provided herein are methods of treating a subject with a bacterial infection including administering to a subject a bacteriophage composition that includes a bacteriophage with a polynucleotide sequence at least 97% identity with SEQ ID NO: 4. In embodiments, provided herein are methods of treating a subject with a bacterial infection including administering to a subject a bacteriophage composition that includes a bacteriophage with a polynucleotide sequence at least 98% identity with SEQ ID NO: 4. In embodiments, provided herein are methods of treating a subject with a bacterial infection including administering to a subject a bacteriophage composition that includes a bacteriophage with a polynucleotide sequence at least 99% identity with SEQ ID NO: 4.

In embodiments, provided herein are methods of treating a subject with a bacterial infection including administering to a subject a bacteriophage composition that includes a bacteriophage with polynucleotide sequence SEQ ID NO: 5. In embodiments, provided herein are methods of treating a subject with a bacterial infection including administering to a subject a bacteriophage composition that includes a bacteriophage with a polynucleotide sequence at least 85% identity with SEQ ID NO: 5. In embodiments, provided herein are methods of treating a subject with a bacterial infection including administering to a subject a bacteriophage composition that includes a bacteriophage with a polynucleotide sequence at least 86% identity with SEQ ID NO: 5. In embodiments, provided herein are methods of treating a subject with a bacterial infection including administering to a subject a bacteriophage composition that includes a bacteriophage with a polynucleotide sequence at least 87% identity with SEQ ID NO: 5. In embodiments, provided herein are methods of treating a subject with a bacterial infection including administering to a subject a bacteriophage composition that includes a bacteriophage with a polynucleotide sequence at least 88% identity with SEQ ID NO: 5. In embodiments, provided herein are methods of treating a subject with a bacterial infection including administering to a subject a bacteriophage composition that includes a bacteriophage with a polynucleotide sequence at least 89% identity with SEQ ID NO: 5. In embodiments, provided herein are methods of treating a subject with a bacterial infection including administering to a subject a bacteriophage composition that includes a bacteriophage with a polynucleotide sequence at least 90% identity with SEQ ID NO: 5. In embodiments, provided herein are methods of treating a subject with a bacterial infection including administering to a subject a bacteriophage composition that includes a bacteriophage with a polynucleotide sequence at least 91% identity with SEQ ID NO: 5. In embodiments, provided herein are methods of treating a subject with a bacterial infection including administering to a subject a bacteriophage composition that includes a bacteriophage with a polynucleotide sequence at least 92% identity with SEQ ID NO: 5. In embodiments, provided herein are methods of treating a subject with a bacterial infection including administering to a subject a bacteriophage composition that includes a bacteriophage with a polynucleotide sequence at least 93% identity with SEQ ID NO: 5. I In embodiments, provided herein are methods of treating a subject with a bacterial infection including administering to a subject a bacteriophage composition that includes a bacteriophage with a polynucleotide sequence at least 94% identity with SEQ ID NO: 5. In embodiments, provided herein are methods of treating a subject with a bacterial infection including administering to a subject a bacteriophage composition that includes a bacteriophage with a polynucleotide sequence at least 95% identity with SEQ ID NO: 5. In embodiments, provided herein are methods of treating a subject with a bacterial infection including administering to a subject a bacteriophage composition that includes a bacteriophage with a polynucleotide sequence at least 96% identity with SEQ ID NO: 5. In embodiments, provided herein are methods of treating a subject with a bacterial infection including administering to a subject a bacteriophage composition that includes a bacteriophage with a polynucleotide sequence at least 97% identity with SEQ ID NO: 5. In embodiments, provided herein are methods of treating a subject with a bacterial infection including administering to a subject a bacteriophage composition that includes a bacteriophage with a polynucleotide sequence at least 98% identity with SEQ ID NO: 5. In embodiments, provided herein are methods of treating a subject with a bacterial infection including administering to a subject a bacteriophage composition that includes a bacteriophage with a polynucleotide sequence at least 99% identity with SEQ ID NO: 5.

In embodiments, provided herein are methods of treating a subject with a bacterial infection including administering to a subject a bacteriophage composition that includes a bacteriophage with polynucleotide sequence SEQ ID NO: 6. In embodiments, provided herein are methods of treating a subject with a bacterial infection including administering to a subject a bacteriophage composition that includes a bacteriophage with a polynucleotide sequence at least 85% identity with SEQ ID NO: 6. In embodiments, provided herein are methods of treating a subject with a bacterial infection including administering to a subject a bacteriophage composition that includes a bacteriophage with a polynucleotide sequence at least 86% identity with SEQ ID NO: 6. In embodiments, provided herein are methods of treating a subject with a bacterial infection including administering to a subject a bacteriophage composition that includes a bacteriophage with a polynucleotide sequence at least 87% identity with SEQ ID NO: 6. In embodiments, provided herein are methods of treating a subject with a bacterial infection including administering to a subject a bacteriophage composition that includes a bacteriophage with a polynucleotide sequence at least 88% identity with SEQ ID NO: 6. In embodiments, provided herein are methods of treating a subject with a bacterial infection including administering to a subject a bacteriophage composition that includes a bacteriophage with a polynucleotide sequence at least 89% identity with SEQ ID NO: 6. In embodiments, provided herein are methods of treating a subject with a bacterial infection including administering to a subject a bacteriophage composition that includes a bacteriophage with a polynucleotide sequence at least 90% identity with SEQ ID NO: 6. In embodiments, provided herein are methods of treating a subject with a bacterial infection including administering to a subject a bacteriophage composition that includes a bacteriophage with a polynucleotide sequence at least 91% identity with SEQ ID NO: 6. In embodiments, provided herein are methods of treating a subject with a bacterial infection including administering to a subject a bacteriophage composition that includes a bacteriophage with a polynucleotide sequence at least 92% identity with SEQ ID NO: 6. In embodiments, provided herein are methods of treating a subject with a bacterial infection including administering to a subject a bacteriophage composition that includes a bacteriophage with a polynucleotide sequence at least 93% identity with SEQ ID NO: 6. I In embodiments, provided herein are methods of treating a subject with a bacterial infection including administering to a subject a bacteriophage composition that includes a bacteriophage with a polynucleotide sequence at least 94% identity with SEQ ID NO: 6. In embodiments, provided herein are methods of treating a subject with a bacterial infection including administering to a subject a bacteriophage composition that includes a bacteriophage with a polynucleotide sequence at least 95% identity with SEQ ID NO: 6. In embodiments, provided herein are methods of treating a subject with a bacterial infection including administering to a subject a bacteriophage composition that includes a bacteriophage with a polynucleotide sequence at least 96% identity with SEQ ID NO: 6. In embodiments, provided herein are methods of treating a subject with a bacterial infection including administering to a subject a bacteriophage composition that includes a bacteriophage with a polynucleotide sequence at least 97% identity with SEQ ID NO: 6. In embodiments, provided herein are methods of treating a subject with a bacterial infection including administering to a subject a bacteriophage composition that includes a bacteriophage with a polynucleotide sequence at least 98% identity with SEQ ID NO: 6. In embodiments, provided herein are methods of treating a subject with a bacterial infection including administering to a subject a bacteriophage composition that includes a bacteriophage with a polynucleotide sequence at least 99% identity with SEQ ID NO: 6.

In embodiments, provided herein are methods of treating a subject with a bacterial infection including administering to a subject a bacteriophage composition that have any combination polynucleotide sequences of SEQ ID NO: 1, SEQ ID NO: 2, SEQ ID NO: 3, SEQ ID NO: 4, SEQ ID NO: 5, and SEQ ID NO: 6. In embodiments, provided herein are methods of treating a subject with a bacterial infection including administering to a subject a bacteriophage composition including bacteriophage with a polynucleotide sequence of SEQ ID NO: 1, bacteriophage with a polynucleotide sequence of SEQ ID NO: 2, and bacteriophage with a polynucleotide sequence of SEQ ID NO: 3. In embodiments, provided herein are methods of treating a subject with a bacterial infection including administering to a subject a bacteriophage composition including bacteriophage with a polynucleotide sequence of SEQ ID NO: 1, bacteriophage with a polynucleotide sequence of SEQ ID NO: 2, bacteriophage with a polynucleotide sequence of SEQ ID NO: 3, and bacteriophage with a polynucleotide sequence of SEQ ID NO: 4. In embodiments, provided herein are methods of treating a subject with a bacterial infection including administering to a subject a bacteriophage composition including bacteriophage with a polynucleotide sequence of SEQ ID NO: 1, bacteriophage with a polynucleotide sequence of SEQ ID NO: 2, bacteriophage with a polynucleotide sequence of SEQ ID NO: 3, bacteriophage with a polynucleotide sequence of SEQ ID NO: 4, and bacteriophage with a polynucleotide sequence of SEQ ID NO: 5. In embodiments, provided herein are methods of treating a subject with a bacterial infection including administering to a subject a bacteriophage composition including bacteriophage with a polynucleotide sequence of SEQ ID NO: 1, bacteriophage with a polynucleotide sequence of SEQ ID NO: 2, bacteriophage with a polynucleotide sequence of SEQ ID NO: 3, bacteriophage with a polynucleotide sequence of SEQ ID NO: 4, bacteriophage with a polynucleotide sequence of SEQ ID NO: 5, and bacteriophage with a polynucleotide sequence of SEQ ID NO: 6. In embodiments, provided herein are methods of treating a subject with a bacterial infection including administering to a subject a bacteriophage composition that includes a combination bacteriophage comprising any of the polynucleotide sequences (and variations thereof) listed above, as well as one or more of a Pakpunavirus phage (SEQ ID NO: 8), (SEQ ID NO: 9), (SEQ ID NO: 10); one or more of a Bruynoghevirus phage (SEQ ID NO: 11), (SEQ ID NO: 12), (SEQ ID NO: 13); one or more of a Nankokuvirus phage (SEQ ID NO: 14), (SEQ ID NO: 15); one or more of a Phikmvvirus phage (SEQ ID NO: 16), (SEQ ID NO: 17); one or more of a Pbunavirus phage (SEQ ID NO: 18), (SEQ ID NO: 19), (SEQ ID NO: 20), (SEQ ID NO: 21); and one or more of a Litunavirus phage (SEQ ID NO: 22), (SEQ ID NO: 7). In embodiments, provided herein are methods of treating a subject with a bacterial infection including administering to a subject a bacteriophage composition that includes a bacteriophage with a polynucleotide sequence with at least 90% identity to SEQ ID NO: 7, a polynucleotide sequence at least 93% identity to SEQ ID NO: 8, a polynucleotide sequence with at least 93% identity to SEQ ID NO: 9, a polynucleotide sequence with at least 89% identity to SEQ ID NO: 10, a polynucleotide sequence with at least 95% identity to SEQ ID NO: 11, a polynucleotide sequence with at least 91% identity to SEQ ID NO: 12, a polynucleotide sequence with at least 92% identity to SEQ ID NO: 13, a polynucleotide sequence with at least 96% identity to SEQ ID NO: 14 a polynucleotide sequence with at least 95% identity to SEQ ID NO: 15, a polynucleotide sequence with at least 90% identity to SEQ ID NO: 16, a polynucleotide sequence with at least 92% identity to SEQ ID NO: 17, a polynucleotide sequence with at least 95% identity to SEQ ID NO: 18, a polynucleotide sequence with at least 96% identity to SEQ ID NO: 19, a polynucleotide sequence with at least 96% identity to SEQ ID NO: 20, a polynucleotide sequence with at least 96% identity to SEQ ID NO: 21, a polynucleotide sequence with at least 95% identity to SEQ ID NO: 22.

In embodiments, the present disclosure provides a method of treating CF or a bacterial infection in a patient with CF in a subject comprising administering to the subject one or more distinct bacteriophages selected from a bacteriophage comprising a polynucleotide sequence of SEQ ID NO: 1, SEQ ID NO:2, and SEQ ID NO:3. In some embodiments, the method may further comprise administering to the subject a bacteriophage comprising a polynucleotide sequence of SEQ ID NO: 4 and SEQ ID NO: 6.

In embodiments, the present disclosure provides a method of treating pneumonia or a bacterial infection in a subject with pneumonia, comprising administering to the subject one of more distinct bacteriophages selected from a bacteriophage comprising a polynucleotide sequence of SEQ ID NO:1 and SEQ ID NO: 3. In some embodiments, the method may further comprise administering a bacteriophage comprising a polynucleotide sequence of SEQ ID NO: 5 and SEQ ID NO: 8. In some embodiments, the method may further comprise administering a bacteriophage comprising a polynucleotide sequence of SEQ ID NO: 12.

Any one or more of the recited phages may be expressly excluded from any of the embodiments herein, including a composition, method, etc.

Variants of the phages described herein are contemplated that may have anywhere between 85% and 99% identity to any one or more of the phages described herein. Percent identity may be any value or subrange within the recited ranges.

In embodiments, provided herein are methods of treating a subject with a bacterial infection including administering to a subject a bacteriophage composition that includes at least one bacteriophage that is genetically modified. In embodiments, provided herein are methods of treating a subject with a bacterial infection including administering to a subject a bacteriophage composition that includes at least one naturally occurring phage or can exclude naturally occurring phage. In embodiments, provided herein are methods of treating a subject with a bacterial infection including administering to a subject a bacteriophage composition that includes at least one lytic phage. In embodiments, provided herein are methods of treating a subject with a bacterial infection including administering to a subject a bacteriophage composition that includes at least one bacteriophage resistant to inactivation by the sputum.

In embodiments, provided herein are methods for administering a bacteriophage to a subject, where the bacteriophage includes a bacteriophage concentration range between about $1\times10^8$ and about $1\times10^{11}$ PFU per ml of each bacteriophage. In some embodiments, the bacteriophage concentration is $1\times10^8$ to $1\times10^9$ PFU, $1\times10^8$ to $1\times10^{10}$ PFU, or $1\times10^8$ to $1\times10^{11}$ PFU of each phage per ml of composition. In some embodiments, the bacteriophage concentration is $3\times10^8$ to $1\times10^9$ PFU, $3\times10^8$ to $1\times10^{10}$ PFU, or $3\times10^8$ to $1\times10^{11}$ PFU of each phage per ml of composition. In some embodiments, the bacteriophage concentration is $3\times10^8$ to $3\times10^9$ PFU, or $3\times10^8$ to $3\times10^{10}$ PFU of each phage per ml of composition. In some embodiments, the bacteriophage concentration is $1\times10^9$ to $1\times10^{10}$ PFU, or $1\times10^9$ to $1\times10^{11}$ PFU of each phage per ml of composition. In some embodiments, the bacteriophage concentration is $1\times10^{10}$ to $1\times10^{11}$ PFU of each phage per ml of composition. In some embodiments, the bacteriophage is administered to a subject at a dosage of at least about $1\times10^8$ PFU of each phage, at least about $3\times10^8$ PFU of each phage, at least about $1\times10^9$ PFU of each phage, at least about $1\times10^{10}$ PFU of each phage, or at least about $1\times10^{11}$ PFU of each phage per ml of composition. In embodiments, one or more bacteriophage(s) may be combined to form a total concentration of about $1\times10^8$, $3\times10^{8}$ $1\times10^9$, $1\times10^{10}$, or $1\times10^{11}$ PFU of each phage per ml of composition. Concentrations include any value or range within the recited ranges, including endpoints.

In embodiments, the methods provided herein include administering a bacteriophage, where at least about 80% of bacteriophages retain lytic activity after exposure to human plasma for a time period between about 10 and about 20 minutes. In some embodiments, at least about 80% of bacteriophages retain lytic activity after exposure to human plasma for a time period between 10 and 30 minutes. In some embodiments, at least about 80% of bacteriophages retain lytic activity after exposure to human plasma for a time period between 10 and 40 minutes. In some embodiments, at least about 80% of bacteriophages retain lytic activity after exposure to human plasma for a time period between 10 and 50 minutes. In some embodiments, at least about 80% of bacteriophages retain lytic activity after exposure to human plasma for a time period between 10 and 60 minutes. In some embodiments, at least about 80% of bacteriophages retain lytic activity after exposure to human plasma for a time period between 10 and 70 minutes. In some embodiments, at least about 80% of bacteriophages retain lytic activity after exposure to human plasma for a time period between 10 and 80 minutes. In some embodiments, at least about 80% of bacteriophages retain lytic activity after exposure to human plasma for a time period between 10 and 90 minutes. In some embodiments, at least about 80% of bacteriophages retain lytic activity after exposure to human plasma for a time period between 10 and 100 minutes. In some embodiments, at least about 80% of bacteriophages retain lytic activity after exposure to human plasma for a time period between 20 and 30 minutes. In some embodiments, at least about 80% of bacteriophages retain lytic activity after exposure to human plasma for a time period between 20 and 40 minutes. In some embodiments, at least about 80% of bacteriophages retain lytic activity after exposure to human plasma for a time period between 20 and 50 minutes. In some embodiments, at least about 80% of bacteriophages retain lytic activity after exposure to human plasma for a time period between 20 and 60 minutes. In some embodiments, at least about 80% of bacteriophages retain lytic activity after exposure to human plasma for a time period between 20 and 70 minutes. In some embodiments, at least about 80% of bacteriophages retain lytic activity after exposure to human plasma for a time period between 20 and 80 minutes. In some embodiments, at least about 80% of bacteriophages retain lytic activity after exposure to human plasma for a time period between 20 and 90 minutes. In some embodiments, at least about 80% of bacteriophages retain lytic activity after exposure to human plasma for a time period between 20 and 100 minutes. In some embodiments, at least about 80% of bacteriophages retain lytic activity after exposure to human plasma for a time period between 30 and 40 minutes. In some embodiments, at least about 80% of bacteriophages retain lytic activity after exposure to human plasma for a time period between 30 and 50 minutes. In some embodiments, at least about 80% of bacteriophages retain lytic activity after exposure to human plasma for a time period between 30 and 60 minutes. In some embodiments, at least about 80% of bacteriophages retain lytic activity after exposure to human plasma for a time period between 30 and 70 minutes. In some embodiments, at least about 80% of bacteriophages retain lytic activity after exposure to human plasma for a time period between 30 and 80 minutes. In some embodiments, at least about 80% of bacteriophages retain lytic activity after exposure to human plasma for a time period between 30 and 90 minutes. In some embodiments, at least about 80% of bacteriophages retain lytic activity after exposure to human plasma for a time period between 30 and 100 minutes. In some embodiments, at least about 80% of bacteriophages retain lytic activity after exposure to human plasma for a time period between 40 and 50 minutes. In some embodiments, at least about 80% of bacteriophages retain lytic activity after exposure to human plasma for a time period between 40 and 60 minutes. In some embodiments, at least about 80% of bacteriophages retain lytic activity after exposure to human plasma for a time period between 40 and 70 minutes. In some embodiments, at least about 80% of bacteriophages retain lytic activity after exposure to human plasma for a time period between 40 and 80 minutes. In some embodiments, at least about 80% of bacteriophages retain lytic activity after exposure to human plasma for a time period between 40 and 90 minutes. In some embodiments, the bacteriophages is administered to a subject for a time between 40 and 100 minutes. In some embodiments, at least about 80% of bacteriophages retain lytic activity after exposure to human plasma for a time period between 50 and 60 minutes. In some embodiments, at least about 80% of bacteriophages retain lytic activity after exposure to human plasma for a time period between 50 and 70 minutes. In some embodiments, at least about 80% of bacteriophages retain lytic activity after exposure to human plasma for a time period between 50 and 80 minutes. In some embodiments, at least about 80% of bacteriophages retain lytic activity after exposure to human plasma for a time period between 50 and 90 minutes. In some embodiments, at least about 80% of bacteriophages retain lytic activity after exposure to human plasma for a time period between 50 and 100 minutes. In some embodiments, at least about 80% of bacteriophages retain lytic activity after exposure to human plasma for a time period between 60 and 70 minutes. In some embodiments, at least about 80% of bacteriophages retain lytic activity after exposure to human plasma for a time period between 60 and 80 minutes. In some embodiments, at least about 80% of bacteriophages retain lytic activity after exposure to human plasma for a time period between 60 and 90 minutes. In some embodiments, at least about 80% of bacteriophages retain lytic activity after exposure to human plasma for a time period between 60 and 100 minutes. In some embodiments, at least about 80% of bacteriophages retain lytic activity after exposure to human plasma for a time period between 70 and 80 minutes. In some embodiments, at least about 80% of bacteriophages retain lytic activity after exposure to human plasma for a time period between 70 and 90 minutes. In some embodiments, at least about 80% of bacteriophages retain lytic activity after exposure to human plasma for a time period between 70 and 100 minutes. In some embodiments, at least about 80% of bacteriophages retain lytic activity after exposure to human plasma for a time period between 80 and 90 minutes. In some embodiments, at least about 80% of bacteriophages retain lytic activity after exposure to human plasma for a time period between 80 and 100 minutes. In some embodiments, at least about 80% of bacteriophages retain lytic activity after exposure to human plasma for a time period between 90 and 100 minutes. The amount of time may be any value or subrange within the recited ranges, including endpoints. The bacteriophage composition retains at least greater than 80% of its lytic activity in human plasma at the end of the time point.

In embodiments, provided herein are methods of treating a subject with a bacterial infection including administering to the subject one or more distinct bacteriophages. In embodiments, the bacterial infection is selected from pulmonary infection, conditions of lung fibrosis, respiratory conditions of the lung, *Pseudomonas* infections of the lung, and/or rhinosinusitis. In embodiments, provided herein are methods for treating. In embodiments, the pulmonary infection may include, or is associated with, but is not necessary limited to, cystic fibrosis (CF), non-cystic fibrosis bronchiectasis (NCFB), or pneumonia. In embodiments, provided herein are methods of treating a subject with a bacterial infection including administering to the subject one or more distinct bacteriophages, where the bacterial infection is pulmonary infection. In embodiments, provided herein are methods of treating a subject with a bacterial infection including administering to the subject one or more distinct bacteriophages, where the bacterial infection is rhinosinusitis. In embodiments, the bacterial infection is caused by and antibiotic-resistant bacteria.

In embodiments, provided herein are methods of treating a subject with a bacterial infection including administering to the subject one or more distinct bacteriophages. In embodiments, the bacterial infection is selected from pulmonary infection and/or rhinosinusitis, and in the presence of cystic fibrosis. In embodiments, provided herein are methods of treating a subject with a bacterial infection including administering to the subject one or more distinct bacteriophages, where the bacterial infection is pulmonary infection, in addition to cystic fibrosis. In embodiments, provided herein are methods of treating a subject with a bacterial infection including administering to the subject one or more distinct bacteriophages, where the bacterial infection is rhinosinusitis, in addition to cystic fibrosis. In embodiments, the bacterial infection is caused by and antibiotic-resistant bacteria.

In embodiments, provided herein are methods of treating a subject with a bacterial infection including administering to a subject one or more bacteriophages administered via inhalation. In embodiments, provided herein are methods of treating a subject with a bacterial infection including administering to a subject one or more bacteriophages administered via nebulization.

In some embodiments, the bacteriophage composition is the primary treatment, or first medical treatment for a bacterial infection. In some embodiments, the bacteriophages or bacteriophage compositions described herein are applied to an infection that was previously treated by and/or unresolved by treatment with antibiotics. In some embodiments, the bacteriophages or bacteriophage compositions described herein are applied to an infection with one or more bacterial species that are resistant to antibiotics. In some embodiments, the methods include treating a bacterial infection by treating the infection with both a bacteriophage treatment and an antibiotic treatment.

In embodiments, provided herein are methods for treating bacterial infection by administering any bacteriophage composition described herein in combination with an antibiotic. In embodiments, the antibiotic is selected from fluoroquinolone, carbapenem, aminoglycoside, ansamycin, cephalosporin, penicillin, beta lactam, beta lactamase inhibitor, folate pathway inhibitor, fucidane, glycopeptide, glycylcycline, lincosamide, lipopeptide, macrolide, quinolone, oxazolidinone, phenicol phosphonic acid, streptogramin, tetracycline, sulfonamide, imipenem, meropenem, amikacin, ciprofloxacin, levofloxacin, tobramycin, azithromycin, aztreonam, colistin, inhaled tobramycin, inhaled aztreonam, and inhaled colistin. In embodiments, provided herein are methods for treating bacterial infection by administering any bacteriophage composition described herein in combination with fluoroquinolone. In embodiments, provided herein are methods for treating bacterial infection by administering any bacteriophage composition described herein in combination with carbapenem. In embodiments, provided herein are methods for treating bacterial infection by administering any bacteriophage composition described herein in combination with aminoglycoside. In embodiments, provided herein are methods for treating bacterial infection by administering any bacteriophage composition described herein in combination with ansamycin. In embodiments, provided herein are methods for treating bacterial infection by administering any bacteriophage composition described herein in combination with cephalosporin. In embodiments, provided herein are methods for treating bacterial infection by administering any bacteriophage composition described herein in combination with penicillin. In embodiments, provided herein are methods for treating bacterial infection by administering any bacteriophage composition described herein in combination with beta lactam. In embodiments, provided herein are methods for treating bacterial infection by administering any bacteriophage composition described herein in combination with beta lactamase inhibitor. In embodiments, provided herein are methods for treating bacterial infection by administering any bacteriophage composition described herein in combination with folate pathway inhibitor. In embodiments, provided herein are methods for treating bacterial infection by administering any bacteriophage composition described herein in combination with fucidane. In embodiments, provided herein are methods for treating bacterial infection by administering any bacteriophage composition described herein in combination with glycopeptide. In embodiments, provided herein are methods for treating bacterial infection by administering any bacteriophage composition described herein in combination with glycylcycline. In embodiments, provided herein are methods for treating bacterial infection by administering any bacteriophage composition described herein in combination with lincosamide. In embodiments, provided herein are methods for treating bacterial infection by administering any bacteriophage composition described herein in combination with lipopeptide. In embodiments, provided herein are methods for treating bacterial infection by administering any bacteriophage composition described herein in combination with macrolide. In embodiments, provided herein are methods for treating bacterial infection by administering any bacteriophage composition described herein in combination with quinolone. In embodiments, provided herein are methods for treating bacterial infection by administering any bacteriophage composition described herein in combination with oxazolidinone. In embodiments, provided herein are methods for treating bacterial infection by administering any bacteriophage composition described herein in combination with phenicol phosphonic acid. In embodiments, provided herein are methods for treating bacterial infection by administering any bacteriophage composition described herein in combination with streptogramin. In embodiments, provided herein are methods for treating bacterial infection by administering any bacteriophage composition described herein in combination with tetracycline. In embodiments, provided herein are methods for treating bacterial infection by administering any bacteriophage composition described herein in combination with sulfonamide. In embodiments, provided herein are methods for treating bacterial infection by administering any bacteriophage composition described herein in combination with imipenem. In embodiments, provided herein are methods for treating bacterial infection by administering any bacteriophage composition described herein in combination with meropenem. In embodiments, provided herein are methods for treating bacterial infection by administering any bacteriophage composition described herein in combination with amikacin. In embodiments, provided herein are methods for treating bacterial infection by administering any bacteriophage composition described herein in combination with ciprofloxacin. In embodiments, provided herein are methods for treating bacterial infection by administering any bacteriophage composition described herein in combination with levofloxacin. In embodiments, provided herein are methods for treating bacterial infection by administering any bacteriophage composition described herein in combination with tobramycin. In embodiments, provided herein are methods for treating bacterial infection by administering any bacteriophage composition described herein in combination with azithromycin. In embodiments, provided herein are methods for treating bacterial infection by administering any bacteriophage composition described herein in combination with aztreonam. In embodiments, provided herein are methods for treating bacterial infection by administering any bacteriophage composition described herein in combination with colistin. In embodiments, provided herein are methods for treating bacterial infection by administering any bacteriophage composition described herein in combination with inhaled tobramycin. In embodiments, provided herein are methods for treating bacterial infection by administering any bacteriophage composition described herein in combination with inhaled aztreonam. In embodiments, provided herein are methods for treating bacterial infection by administering any bacteriophage composition described herein in combination with inhaled colistin. Any one or more treatments described herein may be expressly excluded.

In embodiments, provided herein are methods for treating bacterial infection by administering any bacteriophage composition described herein in combination with a treatment for cystic fibrosis. In embodiments, the cystic fibrosis treatment is selected from CFTR modulator therapies, mucus thinners, airway clearance techniques, inhaled corticosteroids, oral corticosteroids, leukotriene modifiers, inhaled anticholinergics, dornase alfa, inhaled bronchodilators, inhaled hypertonic saline, and inhaled beta-agonists. In embodiments, provided herein are methods for treating bacterial infection by administering any bacteriophage composition described herein in combination with CFTR modulator therapies. In embodiments, provided herein are methods for treating bacterial infection by administering any bacteriophage composition described herein in combination with mucus thinners. In embodiments, provided herein are methods for treating bacterial infection by administering any bacteriophage composition described herein in combination with airway clearance techniques. In embodiments, provided herein are methods for treating bacterial infection by administering any bacteriophage composition described herein in combination with inhaled corticosteroids. In embodiments, provided herein are methods for treating bacterial infection by administering any bacteriophage composition described herein in combination with oral corticosteroids. In embodiments, provided herein are methods for treating bacterial infection by administering any bacteriophage composition described herein in combination with leukotriene modifiers. In embodiments, provided herein are methods for treating bacterial infection by administering any bacteriophage composition described herein in combination with inhaled anticholinergics. In embodiments, provided herein are methods for treating bacterial infection by administering any bacteriophage composition described herein in combination with domase alfa. In embodiments, provided herein are methods for treating bacterial infection by administering any bacteriophage composition described herein in combination with inhaled bronchodilators. In embodiments, provided herein are methods for treating bacterial infection by administering any bacteriophage composition described herein in combination with inhaled hypertonic saline. In embodiments, provided herein are methods for treating bacterial infection by administering any bacteriophage composition described herein in combination with inhaled beta-agonists. Any one or more treatments described herein may be expressly excluded.

In embodiments, provided herein are methods of administering to a subject any of the bacteriophage described herein, where administration is over a range of about 6 to about 24 hours. In embodiments, the bacteriophage is administered to a subject every 3 hours. In embodiments, the bacteriophage is administered to a subject every 4 hours. In embodiments, the bacteriophage is administered to a subject every 5 hours. In embodiments, the bacteriophage is administered to a subject every 6 hours. In embodiments, the bacteriophage is administered to a subject every 7 hours. In embodiments, the bacteriophage is administered to a subject every 8 hours. In embodiments, the bacteriophage is administered to a subject every 9 hours. In embodiments, the bacteriophage is administered to a subject every 10 hours. In embodiments, the bacteriophage is administered to a subject every 11 hours. In some embodiments, the bacteriophage is administered to a subject every 12 hours. In embodiments, the bacteriophage is administered to a subject every 18 hours. In embodiments, the bacteriophage is administered to a subject every 24 hours.

In embodiments, the bacteriophage composition is administered for at least one day. In embodiments, the bacteriophage composition is administered for a total of 2 days. In embodiments, the bacteriophage composition is administered for a total of 3 days. In embodiments, the bacteriophage composition is administered for a total of 4 days. In embodiments, the bacteriophage composition is administered for a total of 5 days. In embodiments, the bacteriophage composition is administered for a total of 6 days. In embodiments, the bacteriophage composition is administered for a total of 7 days. In embodiments, the bacteriophage composition is administered for a total of 10 days. In embodiments, the bacteriophage composition is administered for a total of 14 days. In embodiments, the bacteriophage composition is administered for a total of 21 days. In embodiments, the bacteriophage composition is administered for a total of 28 days. In embodiments, the bacteriophage composition is administered for between one day and about four weeks. The duration of administration may be any value or subrange within the recited ranges, including endpoints.

In embodiments, provided herein are methods of administration of a bacteriophage composition to a subject where the subject is human.

In embodiments, the methods described herein are used to treat bacterial infections, including bacterial infections associated with diseases. The infections can include pulmonary infections, and/or rhinosinusitis. In some embodiments, the disease can be cystic fibrosis, and, the method, for example, can include treating a bacterial infection associated with cystic fibrosis. In some embodiments, the disease can be non-cystic fibrosis (NCFB), and the method, for example, can include treating a bacterial infection associated with NCFB. In some embodiments, the disease can be pneumonia.

EXAMPLES

Example 1: Bacteriophage Composition Overview

Experiments were conducted to create a bacteriophage therapy that met the following criteria: 1) Obligately lytic, to avoid specialized transduction of bacterial genes; 2) Not known, by empirical testing and/or inference from genomics, to be prone to generalized transduction, and 3) Fully sequenced, to avoid phages with genes known to carry antibiotic resistance or bacterial virulence genes.

Collectively, the phages used together to treat a subject should: 1) have broad activity against the target pathogen but not other species, to maximize potential utility and minimize off-target effects, and 2) be capable of complementation, in which resistant mutants arising to one phage are sensitive to another phage.

In addition to characteristics of the phages themselves, material for clinical use should be produced in such a way as to give confidence that the final product retains these characteristics (i.e. are still the same phages) and does not contain potentially harmful (or harmful amounts) of impurities such as endotoxin or host cell proteins.

Each of the phages were identified by acquiring a diverse panel of *Pseudomonas aeruginosa* (PA) isolates that were then screened against a proprietary phage collection (about 350 PA viruses) to identify phages that exhibited both broad host range coverage and robust potency. Similar to antibiotics, bacteria are considered susceptible to phage if the minimum inhibitory concentration is less or equal to the susceptibility breakpoint of $10^3$ phage/mL which corresponds to about 0.1 μg/mL of protein.

Each of the phage candidates was then advanced through a series of selection criteria and different methods, including sequencing, bioinformatics and comparative genomics, in order to identify potential receptors, phage identity and confirm lytic activity. This process yielded a smaller candidate phage pool with the desired attributes for a product candidate, namely, broad host range, complementarity, compatibility and targeting different bacterial receptors which are essential intrinsic attributes that contribute to the robustness and potency of the therapeutic cocktail. Complementarity aims to ensure that a clinical isolate is targeted by more than one phage which limits the emergence of resistance. Targeting different receptors on the surface of bacteria also contributes to resistance prevention and also has the potential to decrease bacterial virulence and fitness. Compatibility between different components of the multi-phage product ensures that the activity of one phage does not interfere with the infectivity of another phage.

Phage candidates were then validated for efficacy and potency. Specifically, this included performing killing kinetic assays to demonstrate cooperativity, activity in bodily fluids and in the presence of current anti-Pseudomonal therapies in vitro and biofilm inactivation.

Phages were also selected based on manufacturing feasibility and process optimization efforts with the goal of achieving high-quality phage product free host cell proteins and other contaminants whilst maintaining adequate phage titers. Equally important, the ability to formulate phage components in the same diluent suitable for inhalation and intravenous (IV) delivery that would allow long term stability can be an important consideration in the selection process.

Example 2: Selection of Phage Components for Optimized Product Cocktail

Selection of a large pool of phage candidates with robust host range and robust potency. A large diverse panel of *Pseudomonas aeruginosa* isolates from CF patients (>300 strains) and pneumonia patients (>200 strains), that incorporated historical strains as well as relevant emerging isolates from a variety of geographies worldwide including the U.S. and Europe, was screened against proprietary phage collection (>200 phage isolates). This resulted in a large lead pool comprised of phages that exhibited both broad host range coverage and robust potency.

Selection of cocktail components. Each of the phage candidates was then advanced through a series of selection criteria and different methods, including sequencing, host range measurement, bioinformatics and comparative genomics, in order to identify receptors, families, and confirm lytic activity. Host range measurement allows for the assessment of the ability to infect and reproduce in a strain as judged by the ability to produce plaques from a small number of infecting particles. This process yielded a smaller candidate phage pool with the desired attributes for a product candidate, namely, broad host range and complementarity, compatibility, distinct receptors, and diverse families. As described above, complementarity, compatibiltors on the surface of bacteria also contributes to resistance prevention and also has the potential to decrease bacterial virulence and fitness. Compatibility between different components of the multi-phage product ensures that the activity of one phage does not interfere with the infectivity of another phage.

Antimicrobial activity. The next step involved screening and validating the phages selected for the product candidate. Specifically, this included performing killing kinetic assays to demonstrate cooperativity, activity in sputum and in the presence of current CF therapies in vitro. Further, the behavior and drug-like attributes of the phages were tested in vivo. Several preclinical animal models were established to evaluate pharmacological parameters to confirm the antimicrobial potential of the phage cocktail.

Further refinement of the cocktail. Utilizing the breadth and depth of data acquired from this integrated approach, a robust multiple-phage therapeutic candidate was identified. Depending on the geographical provenience of clinical isolates, phage candidates cover different numbers of clinical isolates. For example, phage candidates may cover 82% of CF isolates from Europe and 95% of CF strains from a single center in Southern California. To ensure adequate worldwide coverage, the cocktail is comprised of at least 3 obligately lytic phages originating from distinct families and subfamilies, targeting multiple receptor classes, functioning with compatibility and cooperativity and further characterized by being highly potent and having a broad host range and overlap. The cocktail demonstrated broad coverage against approximately 73% of tested CF clinical isolates (305 strains tested) from diverse geographic regions (US, UK, Europe). The cooperativity and compatibility are exemplified by the ability of the cocktail to completely inhibit the growth of a clinical isolate compared to individual phage components at a certain bacteria-virus MOI. These data suggest that potentially the potency of the cocktail can be enhanced by selecting phage that target different surface receptors and have distinct mechanisms of action.

A list of phages for a therapeutic cocktail are in Table 1. APBP23 (SEQ ID NO:23), APBP1 (SEQ ID NO:1), APBP3 (SEQ ID NO:3), was tested, along with additional phages APBP4 (SEQ ID NO:4), APBP5 (SEQ ID NO:5), and APBP6 (SEQ ID NO:6) to make 5-phage cocktails:

TABLE 1

| Country of origin for isolates (number of isolates) | APBP1, APBP23, APBP3 | | APBP1, APBP23, APBP3, APBP4, APBP6 | | APBP1, APBP23, APBP3, APBP4, APBP5 | | APBP1, APBP23, APBP3, APBP6, APBP5 | |
|---|---|---|---|---|---|---|---|---|
| | ≥1 phage | ≥2 phages | ≥1 phage | ≥2 phages | ≥1 phage | ≥2 phages | ≥1 phage | ≥2 phages |
| B (59) | 64% | 37% | 78% | 53% | 66% | 46% | 78% | 49% |
| NL (46) | 76% | 54% | 85% | 67% | 80% | 65% | 85% | 67% |
| US (60) | 80% | 33% | 87% | 52% | 87% | 53% | 88% | 55% |
| AU (65) | 75% | 35% | 88% | 62% | 78% | 55% | 89% | 57% |
| UK 2015 (75) | 81% | 49% | 89% | 73% | 89% | 67% | 92% | 68% |
| UK 2016 (79) | 62% | 30% | 77% | 51% | 78% | 43% | 81% | 49% |
| All (384) | 73% | 39% | 84% | 59% | 80% | 54% | 86% | 57% | ity and targeting different bacterial receptors can be important intrinsic attributes. Complementarity aims to ensure that a clinical isolate is targeted by more than one phage which limits the emergence of resistance. Targeting different recep- A list of phages for a therapeutic cocktail are in Table 2. APBP1, APBP2, and APBP3, was tested, along with additional phages APBP4, APBP5, and APBP6 to make 5-phage cocktails:

TABLE 2

| Country of origin for isolates (number of isolates) | APBP1, APBP2, APBP3 | | APBP1, APBP2, APBP3, APBP4, APBP6 | | APBP1, APBP2, APBP3, APBP4, APBP5 | | APBP1, APBP2, APBP3, APBP6, APBP5 | |
|---|---|---|---|---|---|---|---|---|
| | ≥1 phage | ≥2 phages | ≥1 phage | ≥2 phages | ≥1 phage | ≥2 phages | ≥1 phage | ≥2 phages |
| B (60) | 60% | 40% | 78% | 50% | 63% | 43% | 78% | 73% |
| NL (46) | 74% | 57% | 85% | 63% | 78% | 63% | 83% | 80% |
| US (60) | 88% | 47% | 92% | 58% | 90% | 60% | 92% | 90% |
| AU (64) | 70% | 36% | 86% | 56% | 78% | 52% | 89% | 78% |
| UK 2015 (77) | 82% | 42% | 91% | 74% | 90% | 65% | 92% | 86% |
| UK 2016 (80) | 63% | 31% | 78% | 54% | 68% | 45% | 76% | 66% |
| All (387) | 73% | 41% | 85% | 59% | 78% | 54% | 85% | 79% |

Example 3: Cocktail Performance

The Cocktail is Specific for and Potently Eliminates *P. aeruginosa*

The cocktail demonstrates high potency against clinical *P. aeruginosa* isolates in liquid assays. Growth for some isolates is completely inhibited with as little as an MOI of 0.001, which equates to $10^3$ PFU/mL or less than 1 µg/ml of phage. The potency of each individual phage is not affected by the presence of the other phages.

The killing potential on a subset of *P. aeruginosa* strains, at MOIs 100 to 0.0001 was assessed for individual phage and as a cocktail. The graphs in FIG. 2 depict PA strain DCF16. These data suggest that the components of the cocktail have high killing capacity and can work together for increased antimicrobial activity.

Figures 3A, 3B, 3C, 3D, 3E, 3F:
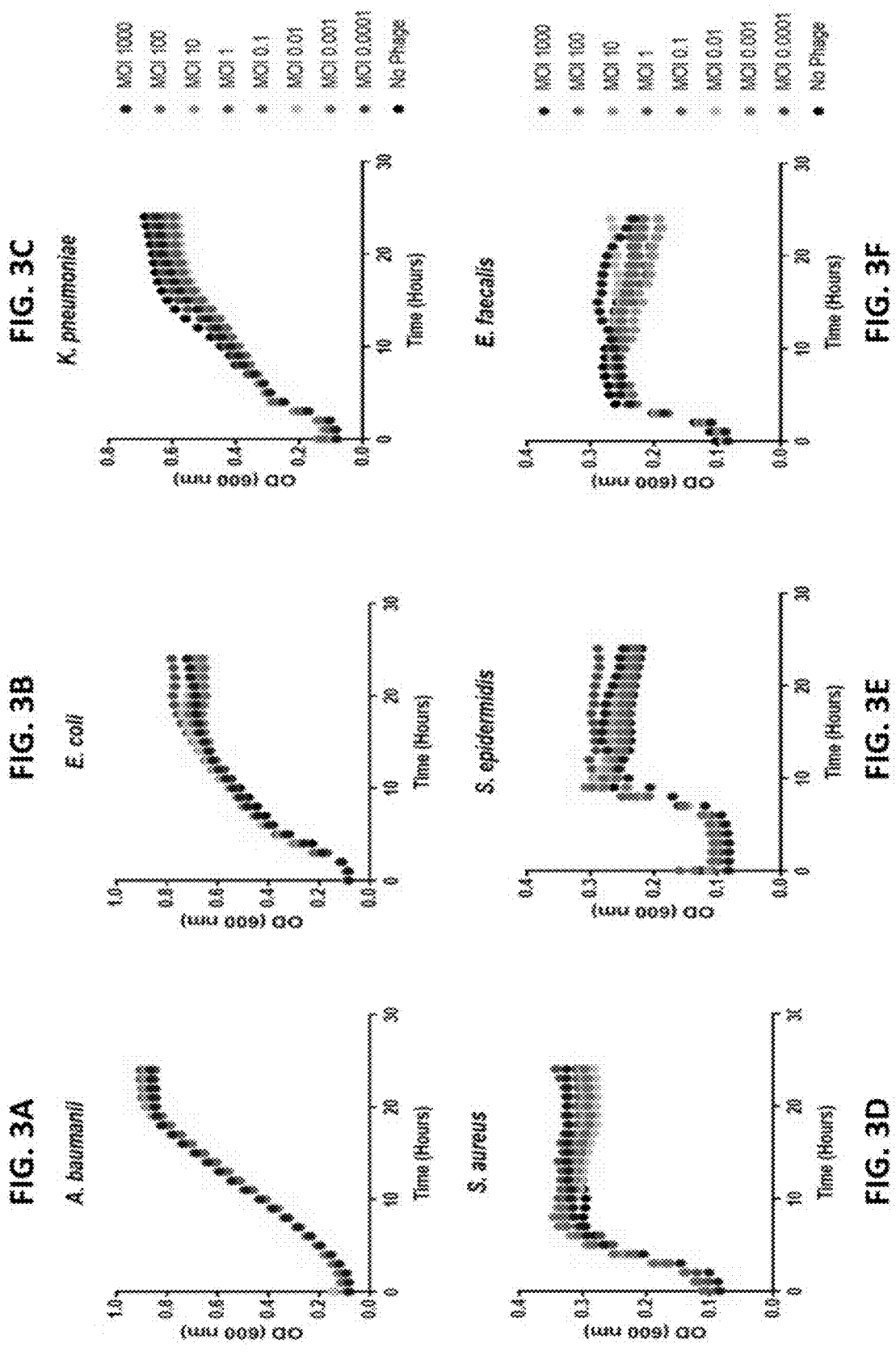
FIGS. 3A-3F are graphs of various bacteria were grown in liquid culture, for 24 hours, with or without varying MOIs of the cocktail. Growth kinetics of samples with phage (colored) were compared to the growth of bacteria alone (black). Data for *A. baumannii* is shown in FIG. 3A, for *E. coli* in FIG. 3B, for *K. pneumonia* in FIG. 3C, for *S. aureus* in FIG. 3D, for *S. epidermidis* in FIG. 3E, and for E. aecalis in FIG. 3F. This suggests that the cocktail does not directly affect other commensal or pathogenic bacteria and has specific activity to *P. aeruginosa*.

*A. baumannii, E. coli, K. pneumoniae, S. aureus, S. epidermidis, E. faecalis* were grown in liquid culture, for 24 hours, with or without varying MOIs of the cocktail. Growth kinetics of samples with phage were compared to the growth of bacteria alone, as shown as plots in FIG. 3. This suggests that the cocktail does not directly affect other commensal or pathogenic bacteria and has specific activity to *P. aeruginosa*.

The Cocktail Disrupts Biofilm Activity In Vitro

Figure 4:
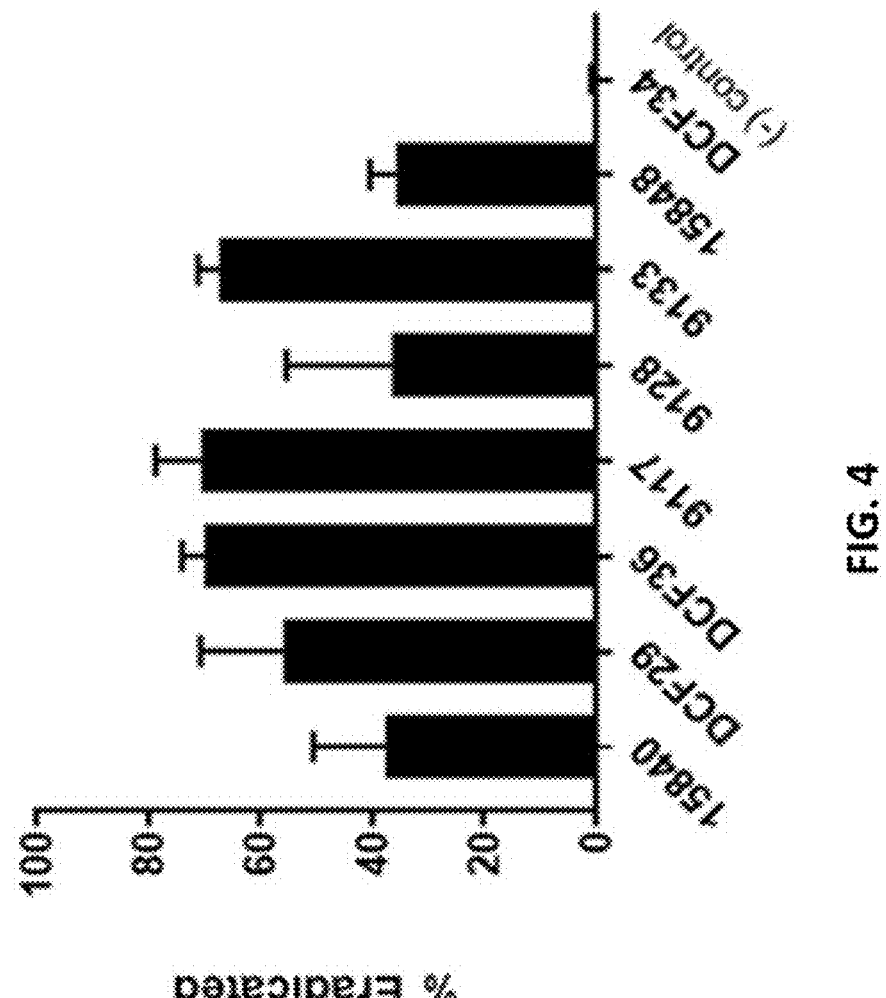
FIG. 4 is data showing the cocktail reduces PA biofilm mass. Biofilms were treated with the cocktail for 4 hours and the percentage of biofilm that was eradicated was calculated (n=5) and is reported as percent relative to the same strain treated with vehicle. PA DCF34 serves as a negative control.

Biofilms formed by several different CF PA clinical isolates were treated for 4 hours with the cocktail product candidate. The remaining biofilm biomass was stained with crystal violet and quantified (FIG. 4). PA strain DCF34 is not infected by any of the component phages of the cocktail and it was used as a negative control. The extent of biofilm eradication varied among strains and it was limited in this assay by the use of one concentration of the cocktail for a limited period of time ($10^3$ phage/well of a 96 well plate; $10^3$ phages correspond to 0.1 pg of protein). Across infected strains, the cocktail eliminated between 60%-80% of the biofilm. These data suggest that the cocktail is able to penetrate pre-existing biofilms and decrease attached biomass.

The Cocktail does not Stimulate the Innate Immune System

Figure 5B:
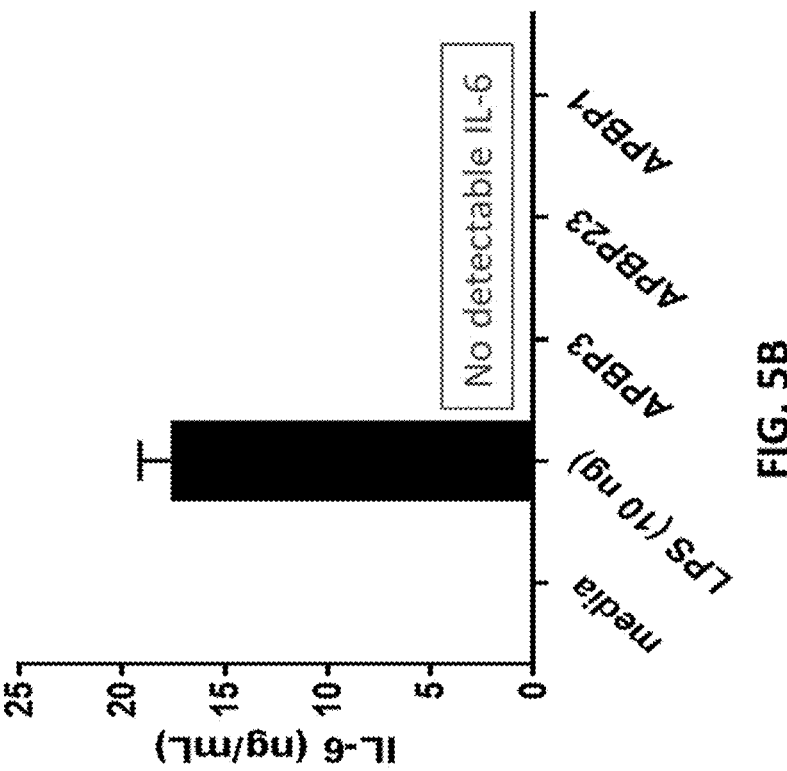
FIGS. 5A-B are data showing stimulation of human PBMCs with purified components of the cocktail does not produce proinflammatory cytokines. Human PBMCs were seeded at 100,000 cells/well and stimulated with either 10 ng of LPS or $1\times10^7$ APBP3, APBP23, or APBP1 for 6 hours. TNF-$\alpha$ (FIG. 5A) and IL-6 (FIG. 5B) in the supernatants were analyzed by ELISA. Graphs depict 1 donor and are representative of 5 donors.
Figure 5A:
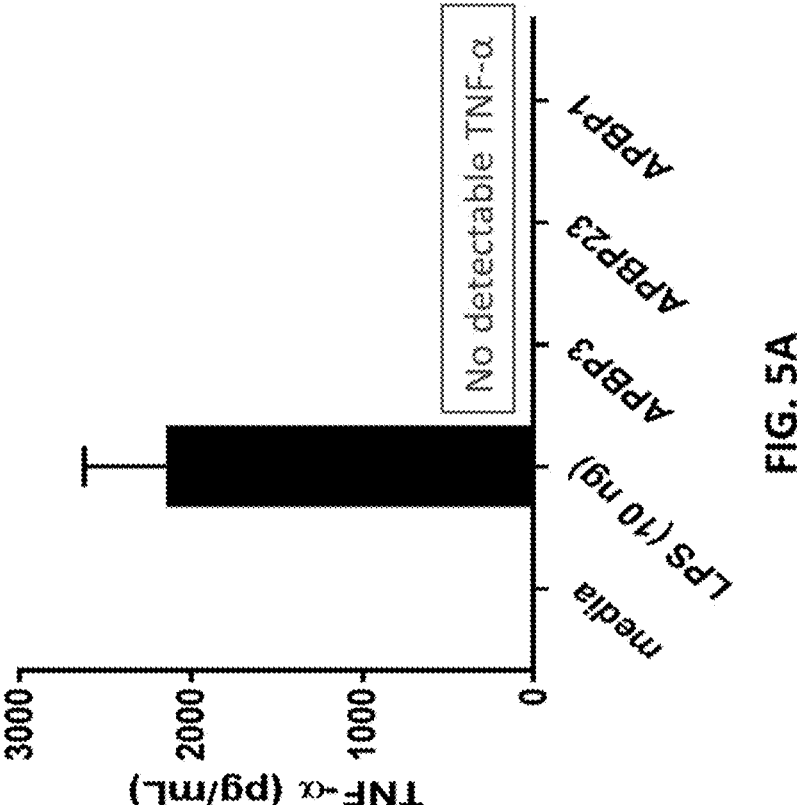

Stimulation of human PBMCs with purified components of the cocktail does not produce proinflammatory cytokines. Human PBMCs were seeded at 100,000 cells/well and stimulated with either 10 ng of LPS or $1\times10^7$ of purified APBP3, APBP23, or APBP1 for 6 hours. TNF-α and IL-6 in the supernatants were analyzed by ELISA. The plots in FIG. 5 depict 1 donor and are representative of 5 donors.

Figure 6:
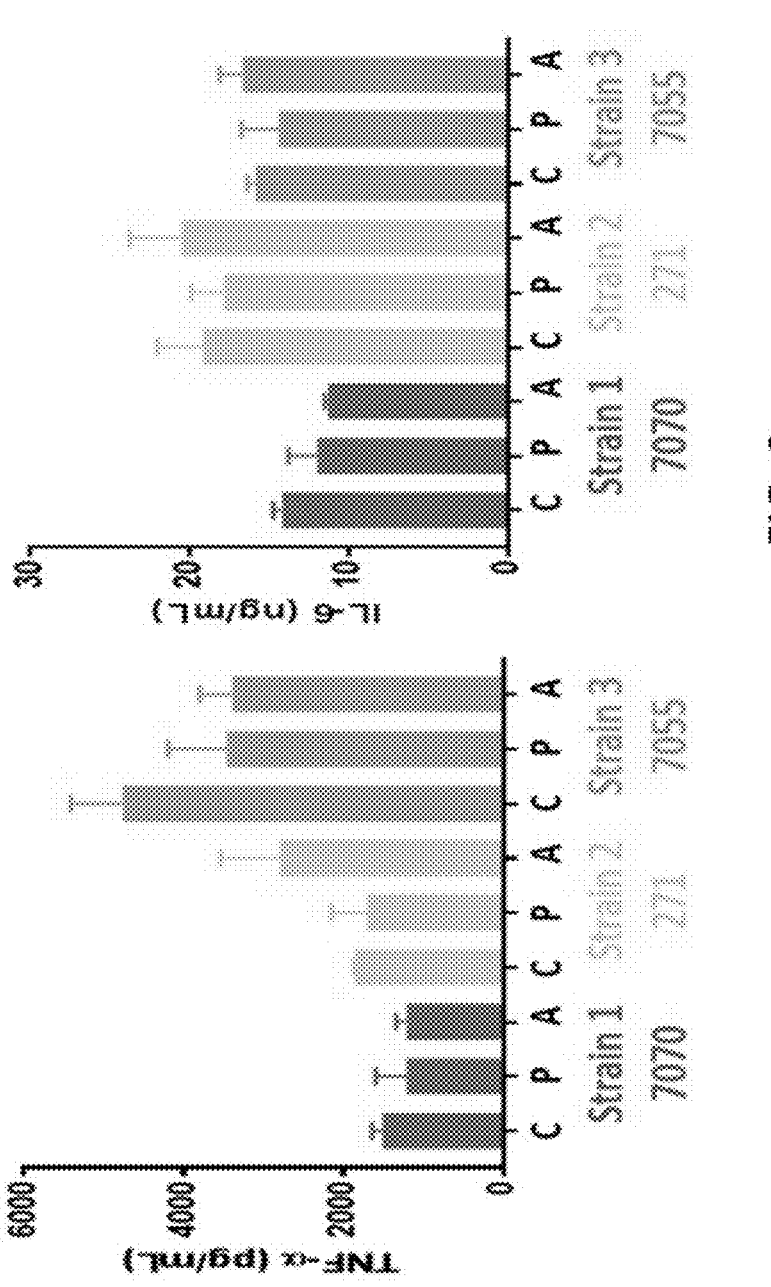
FIG. 6 results from experiments where human PBMCs were stimulated with live *P. aeruginosa* clinical isolates alone (C), in the presence of individual components of the cocktail (P), or Aztreonam (20 μg/mL) (A). A MOI of 1 for bacteria and 10 for phage were added and incubated for 6 hours. Supernatants were collected and TNF-$\alpha$ (left) and IL-6 (right) were analyzed by ELISA. Graphs depict 1 donor and are representative of 5 donors.

The cocktail shows no increase in monocyte activity. Human PBMCs were stimulated with live *P. aeruginosa* clinical isolates alone (C), in the presence of individual components of the cocktail (P), or Aztreonam (20 µg/mL) (A). A MOI of 1 for bacteria and 10 for phage were added and incubated for 6 hours. Supernatants were collected, and TNF-α and IL-6 were analyzed by ELISA. The plots in FIG. 6 depict 1 donor and are representative of 5 donors.

Figures 7A, 7B, 7C:
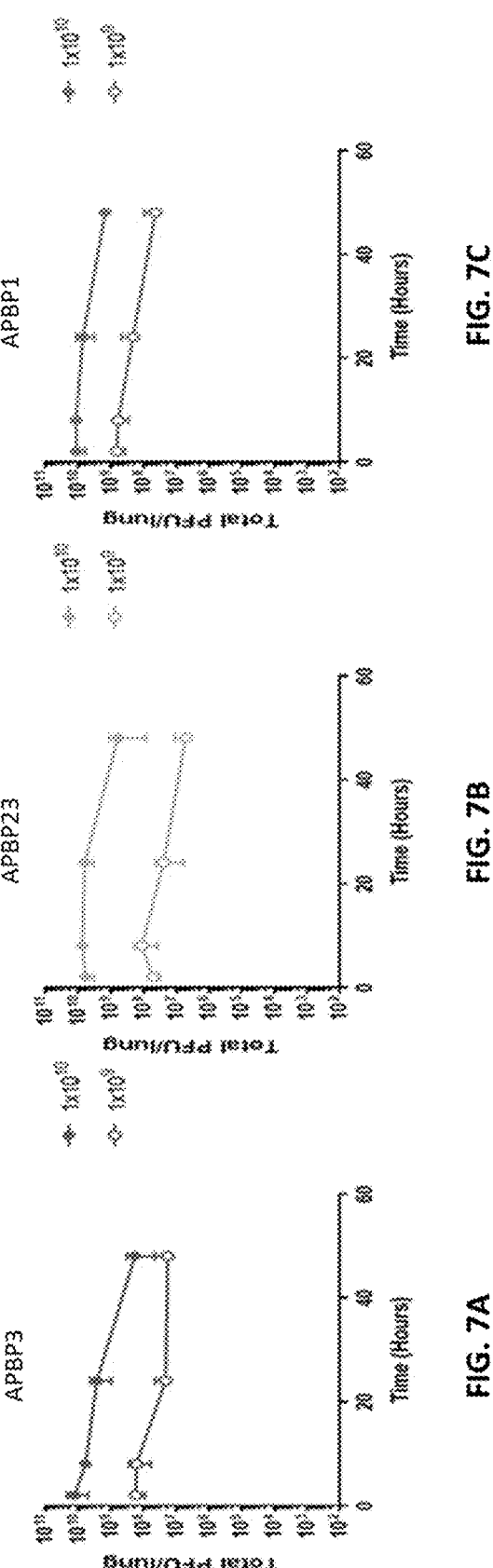
FIGS. 7A-C show individual phage of the cocktail persists in the lung after intranasal delivery. The concentration in the lung compartment of recoverable individual cocktail components APBP3 (FIG. 7A), APBP23 (FIG. 7B), and APBP1 (FIG. 7C) are still capable of infection, and where PFU is plaque forming units, and (n=4).

Cocktail Characterization: It Persists in the Lung after Intranasal Instillation The persistence of individual phages APBP23, APBP1, and APBP3 in the cocktail after delivery to the lungs was examined in BALB/c mice via intranasal (IN) administration of the cocktail ($3\times10^9$ or $3\times10^{10}$ PFU; plaque forming units) (FIG. 7). At 2, 8, 24, and 48 hours post inoculation, bronchoalveolar lavage fluid (BALF) was collected, mice were perfused with saline, and lungs were removed and homogenized in 2 mL of phosphate buffer. Phage titer was determined using a standard agar overlay plaque assay. At 2 hours after intranasal administration of the cocktail, recoveries in the lung compartment were 31-225% for the $3\times10^{10}$ dose and 5-66% for the $3\times10^9$ dose. Active phages are recoverable from the lungs 48 hours after administration of the $3\times10^{10}$ dose (0.5-20%) or the $3\times10^9$ dose (0.05-12%). Recovery of individual phage components of the cocktail in murine lung following intranasal administration is shown in Table 3.

TABLE 3

| Time point | Dose | APBP3 | | APBP23 | | APBP1 | |
|---|---|---|---|---|---|---|---|
| | | Total PFU Mean (Range) | % of total dose Mean (Range) | Total PFU Mean (Range) | % of total dose Mean (Range) | Total PFU Mean (Range) | % of total dose Mean (Range) |
| 2 hours | 1.00E+09 | 1.79E+08 (8.1E+08- 2.8E+08) | 17.9% (8.1- 28.5%) | 5.22E+07 (4.07E+07- 7.56E+07) | 5.2% (3.2- 7.5%) | 6.59E+08 (4.70E+08- 1.07E+09) | 65.8% (47.6- 107.0%) |
| | 1.00E+10 | 1.32E+10 (6.35E+09- 2.25E+10) | 133% (63- 225%) | 6.04E+09 (3.13E+09- 9.7E+09) | 60% (31- 97%) | 1.14E+10 (6.85E+09- 1.73E+10) | 114% (68- 172%) |
| 8 hour | 1.00E+09 | 1.67E+08 (3.68E+07- 2.98E+08) | 16.7% (3.6- 29.7%) | 1.16E+08 (2.11E+07- 2.03E+08) | 11.5% (2.1- 20.2%) | 6.06E+08 (1.48E+08- 8.50E+08) | 60.5% (14.8- 85.0%) |

TABLE 3-continued

| Time point | Dose | APBP3 | | APBP23 | | APBP1 | |
|---|---|---|---|---|---|---|---|
| | | Total PFU Mean (Range) | % of total dose Mean (Range) | Total PFU Mean (Range) | % of total dose Mean (Range) | Total PFU Mean (Range) | % of total dose Mean (Range) |
| | 1.00E+10 | 6.06E+09 (4.37E+09- 7.38E+09) | 61% (43- 73%) | 7.51E+09 (5.3E+09- 9.37E+09) | 75% (53- 93%) | 1.19E+10 (9.56E+09- 1.53E+10) | 119% (95- 152%) |
| 24 hours | 1.00E+09 | 2.15E+07 (5.70E+07- 4.6E+04) | 2.1% (0.004- 5.6%) | 2.47E+07 (4.60E+04- 5.70E+07) | 2.4% (0.005- 4.1%) | 2.15E+08 (1.02E+06- 5.74E+08) | 21.5% (0.1- 57.4%) |
| | 1.00E+10 | 2.71E+09 (1.13E+09- 5.14E+09) | 27% (11- 51%) | 6.50E+09 (2.19E+09- 9.40E+09) | 65% (21- 93%) | 7.37E+09 (3.13E+09- 1.27E+10) | 74% (31- 126%) |
| 48 hours | 1.00E+09 | 1.86E+07 (2.89E+06- 6.14E+07) | 1.8% (0.2- 6.1%) | 5.23E+06 (5.37E+05- 1.37E+07) | 0.5% (0.05- 1.3%) | 4.42E+07 (4.43E+06- 1.21E+08) | 4.4% (0.4- 12.1%) |
| | 1.00E+10 | 1.87E+08 (5.8E+07- 3.13E+08) | 2% (0.5- 3%) | 6.14E+08 (9.2E+07- 1.08E+09) | 6% (0.9- 10%) | 1.52E+09 (1.07E+09- 2.16E+09) | 15% (10- 21%) |

Systemic Exposure of the Cocktail is Limited

Figures 8A, 8B, 8C:
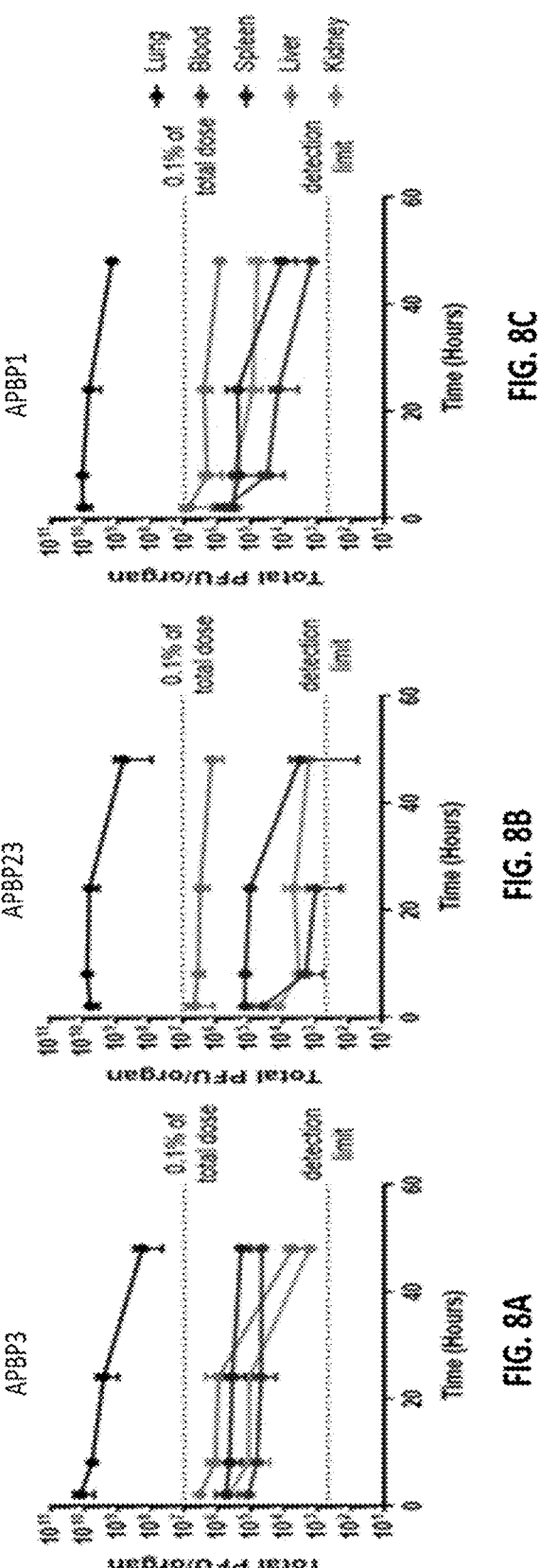
FIGS. 8A-C are results showing cocktail systemic exposure after intranasal instillation is limited. BALB/c mice were treated with $3\times10^{10}$ of the cocktail via intranasal (IN) instillation. At 2, 8, 24, and 48 hours post administration, lung, spleen, kidney, liver, and blood were harvested and analyzed. The total PFU of individual phage APBP3 (FIG. 8A), APBP23 (FIG. 8B), and APBP1 (FIG. 8C) in each organ was determined by the concentration of infectious phage particles that were recovered. Here, PFU is plaque forming units, and (n=4).

As shown in FIG. 8, systemic exposure to the cocktail after intranasal instillation is limited. BALB/c mice were treated with $3 \times 10^{10}$ PFU/µl of the cocktail via intranasal (IN) instillation. At 2, 8, 24, and 48 hours post administration, lung, spleen, kidney, liver, and blood were harvested and analyzed. The total plaque forming units, PFU, of individual phage in each organ was determined by the concentration of infectious phage particles that were recovered.

Figures 9A, 9B:
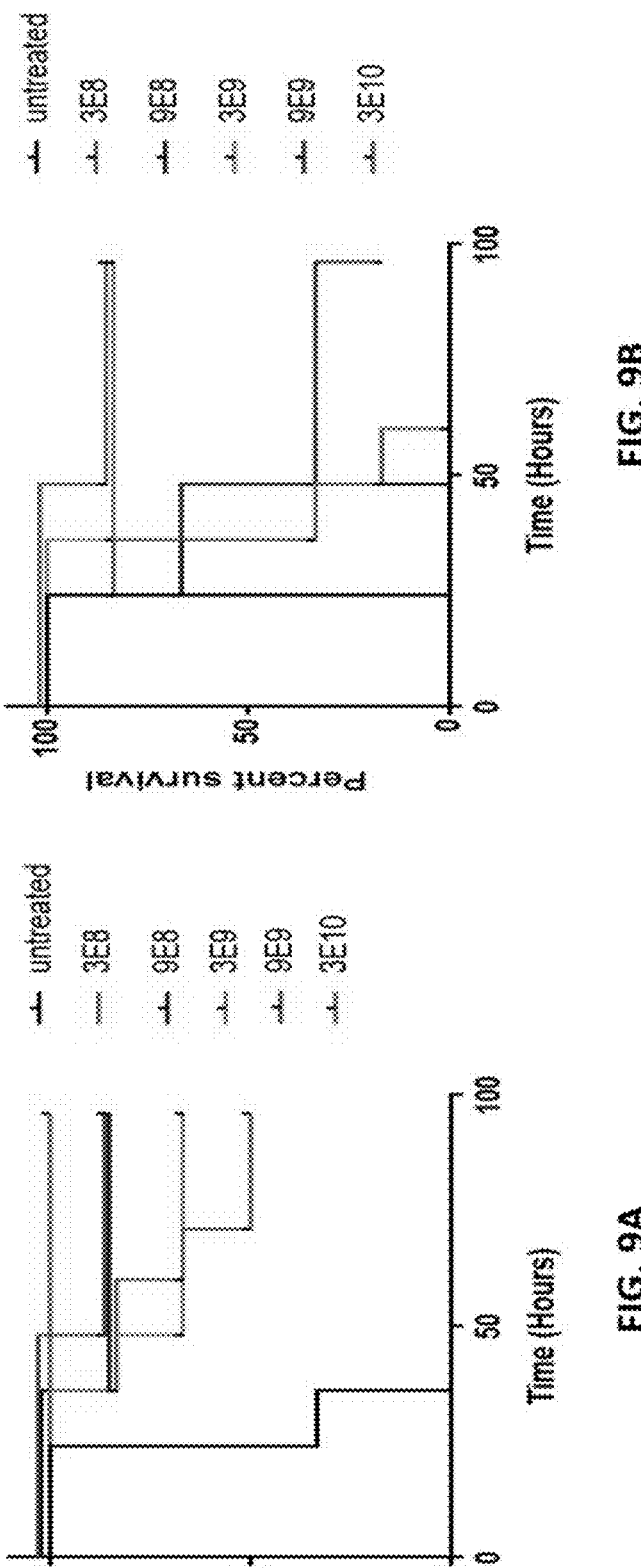
FIG. 9A-B are data showing treatment with a single dose of the cocktail decreases mortality in an acute murine lung model of PA infection. BALB/c mice were inoculated intranasally with $1\times10^8$ colony forming units (CFU) of PA clinical isolate 237 from the CDC Antibiotic Resistant Isolate Bank. One hour following inoculation mice were treated with either a single dose of $3\times10^8$, $9\times10^8$, $3\times10^9$, $9\times10^9$, or $3\times10^{10}$ phage via intranasal instillation, and (n=6) per experiment.

Example 4: The Cocktail Significantly Decreases Mortality in a Murine Model of PA Lung Infection The in vivo efficacy of the cocktail was assessed in a murine model of acute lung infection using the PA237 isolate from the CDC Antibiotic Resistant Isolate Bank (FIG. 9). This clinical isolate is susceptible to all phage in the cocktail. Mice treated with a single dose of the cocktail ($3 \times 10^8$, $9 \times 10^8$, $3 \times 10^9$, $9 \times 10^9$ or $3 \times 10^{10}$ phage) one hour following PA intranasal administration of $1 \times 10^8$ CFU showed a dose depend survival benefit: 50%, 66%, and 100% of mice survived in groups that received $3 \times 10^8$, $9 \times 10^8$, $3 \times 10^9$, $9 \times 10^9$ and $3 \times 10^{10}$ phages respectively, compared with 0% survival in the untreated group (p value $<0.05$).

Figures 10A, 10B:
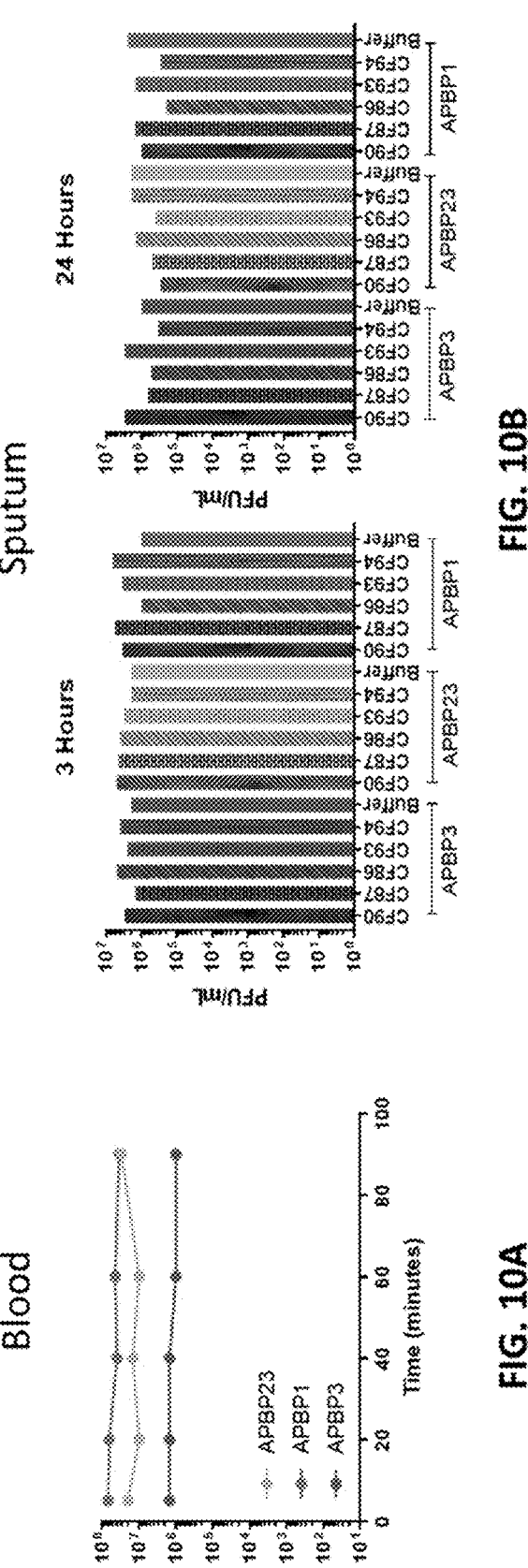
FIGS. 10A-B is data showing that the cocktail components are stable in plasma and sputum.

Cocktail Components are Stable in Bodily Fluids and their Activity is not Impaired By Current CF Therapies The cocktail components are stable in plasma and sputum. As shown in FIG. 10A, the cocktail phage components were diluted in fresh plasma and the activity of phage was monitored for 90 minutes at 37° C. Graph depicts representative data from 1 donor. As shown in FIG. 10B, the cocktail phage components were incubated with sputum from CF patients for 3 or 24 hours at 37° C. PFU, plaque forming units.

Cocktail Component Activity is not Impaired by Current CF Therapies

Standard therapy for patients with CF with a PA infection includes inhaled tobramycin and/or aztreonam. Since CF patients who receive the cocktail are likely to be on these therapies, the effect of the cocktail on these antibiotics and vice versa was assessed.

Figures 11A, 11B:
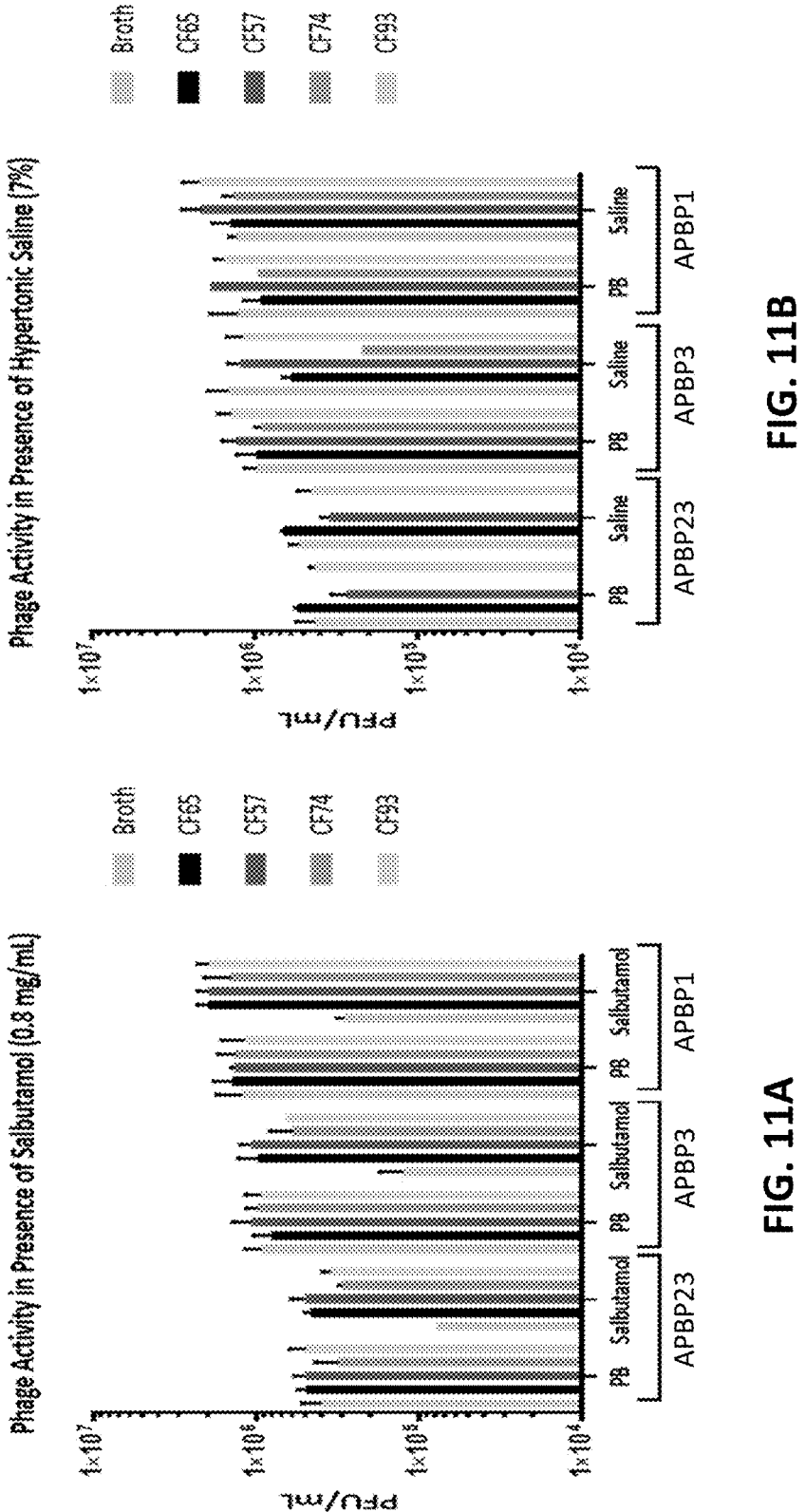
FIGS. 11A-B is data showing that the cocktail components APBP3, APBP23, and APBP1 maintain stability in the presence of other CF therapies. Each phage component was incubated with broth and salbutamol (FIG. 11A) or hypertonic solution (FIG. 11B) for 3 hours and phage activity was assessed by an agar overlay plaque assay. Here, PFU is plaque forming units.

Cocktail components APBP3, APBP23, and APBP1 maintain stability in the presence of other CF therapies. As shown in FIG. 11, each phage component was incubated with broth and salbutamol (FIG. 11A) or hypertonic solution (FIG. 11B) for 3 hours and phage activity was assessed by an agar overlay plaque assay. PFU, plaque forming units. Further, the cocktail is not antagonistic with tobramycin, aztreonam nor colistin, as shown in Table 4 showing results from an adapted Fractional Inhibitory Concentration (FIC) approach that was applied to test combinations of the cocktail with tobramycin, aztreonam or colistin. An FIC $<0.5$ indicates a synergistic effect, FIC 0.5 to 4.0 indicates additive effects, and FIC $>4.0$ indicates antagonistic effects. No evidence of antagonism between the cocktail with any antibiotic was demonstrated.

TABLE 4

Fractional Inhibitory Concentration (FIC) of the cocktail with other compounds.

| Strain | Tobramycin | Aztreonam | Colistin |
|---|---|---|---|
| 7281 | 0.56 | 1 | 1.3 |
| 7282 | 1.06 | 2 | 0.55 |
| 9114 | 0.83 | 0.75 | 0.75 |
| 9115 | 1 | 1 | 0.75 |
| 9117 | 0.37 | 0.51 | 1 |
| 9128 | 1 | 2 | 0.55 |
| DCF 16 | 0.09 | 0.28 | 0.62 |
| DCF 32 | 0.8 | 0.6 | 1 |

Cocktail Components are Active in CF Patient Sputum

Figures 12A, 12B, 12C:
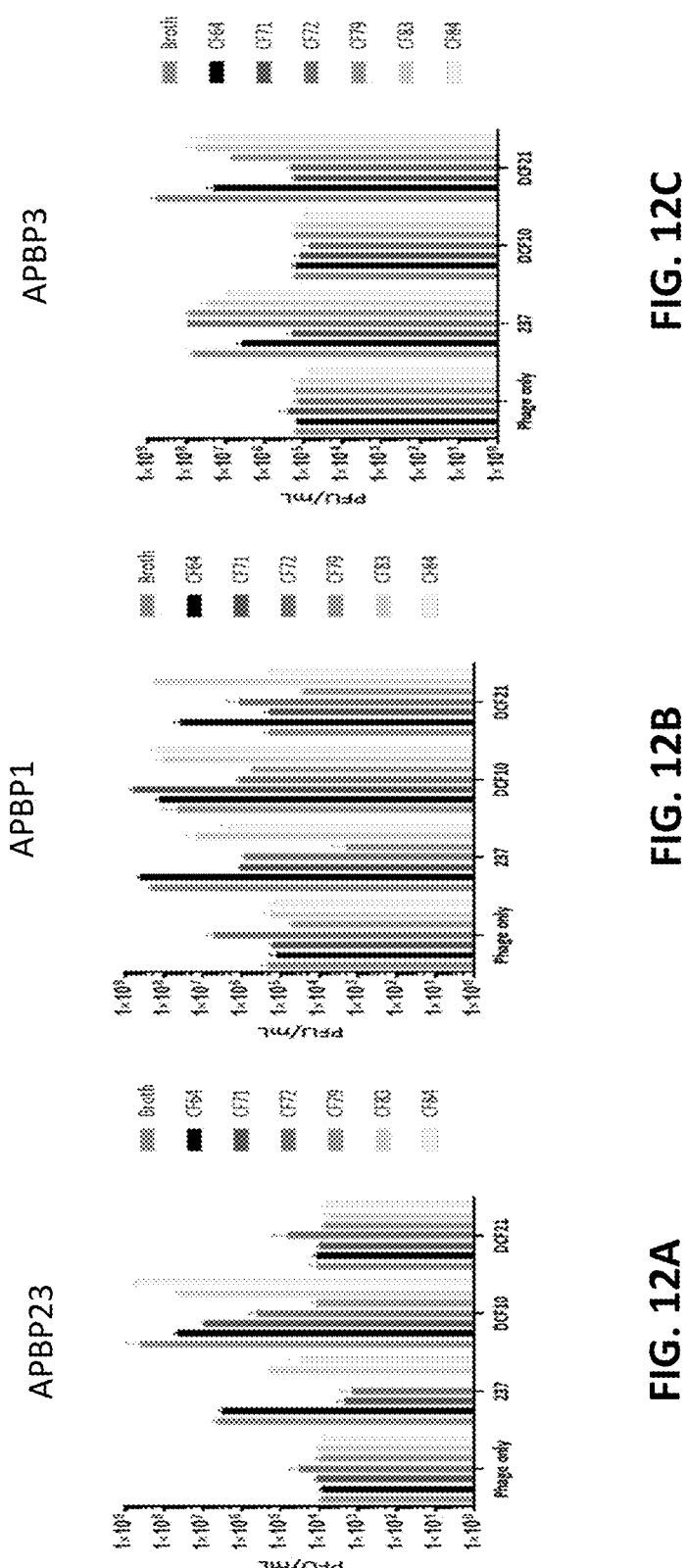
FIGS. 12A-C The cocktail components APBP23, APBP1, and APBP3 are active in CF sputum. Each phage component was incubated in CF sputum alone (phage only) or with 3 different *P. aeruginosa* isolates. PA strain 237 is susceptible to all three phage, strain DCF10 is susceptible to only APBP23 (FIG. 12A) and APBP1 (FIG. 12B), and strain DCF21 is susceptible to only APBP3 (FIG. 12C). Phage titer was determined using an agar overlay plaque assay and compared to the input phage concentration. An increase in titer suggests phage amplification and activity and is observed for susceptible strains only. Here, PFU is plaque forming units.

Cocktail components APBP23, APBP1, and APBP3 are active in CF sputum. As shown in FIG. 12, each phage component was incubated in CF sputum alone (phage only) or with 3 different *P. aeruginosa* isolates. PA strain 237 is susceptible to all three phage, strain DCF10 is susceptible to only APBP23 and APBP1, and strain DCF21 is susceptible to only APBP3. Phage titer was determined using an agar overlay plaque assay and compared to the input phage concentration. An increase in titer suggests phage amplification and activity and is observed for susceptible strains only. PFU, plaque forming units.

Example 5: Antibody Assay

Phage can be used in a bridge ELISA for detection of human anti-drug antibodies (ADA) against each phage that meets the sensitivity requirements by the FDA of at least 100 ng/mL. Using purified antibodies specific to each phage to bridge two phage particles together, this assay can be used to detect ADAs in human serum at a range of 2-7300 ng/mL.

Example 6: General Spotting Assay

Phage of each of APBP1-23 were tested in spotting assays. Briefly, about 1000 PFU of phage was overlaid on a lawns of cultured PA strains and were allowed to incubate overnight. Bacterial plates were then analyzed and quantified for cytopathic effects of each phage comprising a nucleic acid sequence of APBP1-23. Each of the phage was determined to be effective at infecting and killing *Pseudomonas* strains.

Example 7: Spotting Assay Using Bacteria Associated with Pneumonia

About 1000 PFU of phage individually comprising a nucleic acid sequence of APBP1-23 were overlaid on a variety of cultured PA strains that cause pneumonia, as described above. Bacterial plates were then analyzed and quantified for cytopathic effects and each of phage of APBP1-23 was determined to be effective at infecting and killing each *Pseudomonas* associated with pneumonia.

Example 8: Spotting Assay Using Bacterial Infections Associated with Cystic Fibrosis (CF)

1000 PFU of phage of each of APBP1-23 were overlaid on a variety of cultured bacteria that cause CF. Bacterial plates were then analyzed and quantified for cytopathic effects and each of phage of APBP1-23 was determined to be effective at infecting and killing PA strains that may be present in infections of patients with CF.

Example 9: Efficacy of Phage Against PA Associated with NCFB Infections

*Pseudomonas aeruginosa* is a bacterium present in infections in subjects with NCFB. The phage of APBP1-23 were tested for ability to infect and kill *Pseudomonas aeruginosa*. Each of APBP1-23 was shown to be able to infect and kill *Pseudomonas* aeruginosa.

Example 10: Liquid Cultures for Evaluating the Efficacy of Different Combinations of Phage Phages individually comprising nucleic acid sequences according to APBP1-23 were tested to determine their host ranges. Briefly, cultures of *Pseudomonas aeruginosa* were mixed with the cocktail at MOI ranging from 100 to 0.0001 and the effectiveness of the cocktail measured by following optical density for 24 hrs. The curves were compared to those obtained from similar experiments performed with individual phages instead of cocktails. Each phage was determined to have a different host range, rendering them suitable for combining in cocktails due to the phage when combined having broader collective host ranges and the ability to infect and kill *Pseudomonas* aeruginosa.

All publications mentioned in the above specification are herein incorporated by reference. Various modifications and variations of the described methods and system of the present invention will be apparent to those skilled in the art without departing from the scope and spirit of the present invention. Although the present invention has been described in connection with specific preferred embodiments, it should be understood that the invention as claimed should not be unduly limited to such specific embodiments. Indeed, various modifications of the described modes for carrying out the invention which are obvious to those skilled in biochemistry and biotechnology or related fields are intended to be within the scope of the claims.

SEQUENCE LISTING (23 sequences)

SEQ ID NO: 1 - DNA, 66824 bp, Myoviridae Pbunavirus
  misc_feature (1)..(66824)
ttgcacaatcctaatagaaaaaatctatcacggacgttacctatctttaaaattaataaaattaatagtaatttggtaatttggtatactttagtatttgaaagccttgcggcactaagcctgtacacttcccgtcaagtttccgattccgctcaactcgcggcagggtcgccggaaacttccggacttccaatccatgggtcgcggcaacaccacggcggactaagcggcaagtgccaaaactcgacgaacggaaccggaaatttggaagcgcgatagaatcgctcagctggacatatttctaacattcgatttaacactcaatccaaacactcaccgccatcgtctcccgccaaccgccgactcgatcctcacccaccagcggatcgcccgtataacatcctataacaccacctaacactcattcatcatcaaacccacccagacctacagcccacccacaagcagcccatagacgcgatccctggccccatagtacaatcgcgccatactcagtgtcgcggcagagcaccaggggccatccgccaaccaagccaccacgacgactccagaatcgaactcagggacgcagcaccaaatgaccaaattctacagccccgacgatctagtcacgccacaggaattcgcagacccgcatttcgcggcgatcaaccaaaagcgattcgacctgtacatcgacctgcgcgtccaaggttacagctcctggcgggtcttccgggccatctggggcgaggagcatatggacggtcccgcgcaggcccgcatcttcgcgatggagtccaacccgtactatcgcaagcagttcaaggccaagttgaacgcgaccaaaacgtccgatttgtggaatccaaagacggcgctccacgaactcctccaaatggttcgtgaccccaccgtcaaggactccagccgtctgtcggccatcaaggaattgaacgttctggctgaaatcacgttcgtggacgagtcgggcaagacccggatcggtcgcggtttggccgatttctacgcatcagaagccgaggctcagaccgcgaccgtcgctgctgcggccgaagccaatggctatgtgccggaaggtgaagagggagatttcccgtctccgtctccggaaccgaccgaggaagaccgcgccaaccccatttagacataaaataacatcgttctaggcccgaatcggaccgaactaaggcgaaggtagcgggaagggacgaaaaacgattctagggctgttctaggaagccgaccaataacgatcagaagcgacaaagccccggactctagttcagaatccggggctttcttttgggtttcttattctccagcttcgatgatttcgaagttgtatttgacgccttcgtgctcgaaagtcaatttgccggacgctttcagctgcatgcggaatcggatgcacttagaggaaggcaaaccgaactcgatgaaggctgcgttgcaggatttgaactcgccgcgcttgcctttcacggtgaccgccacgccatgacgctcggtgcgcttgcgggcgacttccgggtctttccaggagttggcgatggctgctgacaggtctttggtctctttggttttctccggcgcgttcttcgcctcttcgcgcattttccggatttcttccagcgcttcctcttcggtgatttcttcttccggcttcagattctcttcggccttctcttctgccttcttcttggaagtgcgggttttgtaaaccttggccggggtttcctcttcctggaaggcctcttcctcggccggcagagcgttcaggatggcgaggcagcgacgctcagcggtcttgcggtcagagaagcgcttgacagtcgcatcggcgttgtgagcgttgtagaaggcgaccagttctttcatttctgcgttctggatgtcgccgaaggttttgatggagttggtcattttgcgatcctctgttttggaagatttcgtttgggcttcagtttgtcgccccgttgaaagagattatgcctaggtcgatgctgcgtgtctacatctatttcatcagattgatcacaaagccgacgaacggttgtctgatgtgaaaacaccgcagagcaggctgcggtgtttgttggcgttggggtgatgtcagaaagtcgggactgtgataggctcgatgggcggatcgccgggcctgtcgttgtccgatgcgggcgccgggctggaagggatcgcacccgaccgaagcgccagcgattccgactgcctgcttacctgcggagctggaggcgcttttggcgcatgaggcgcgggcggaaccggcaggcctggaggagccatcggcgccctgggcggctccggaagatcgggcagatcaggaagactcggcgctatgccgccaaaggaccgctgcgaccgctgcgacggattgtcgccgaacatttcggcggatcggttgtccttgatgacttgacctatggccgtcttgtcgccacccggttctgctggatcgaagcccgtgaatggagtggtaacgcagcgcatgttcggatgggtcggcagattgttcaggacgatggagtccgcccagacatacgggtttttgtggttgccgggtccgtggctgatgatctcggcaggaatatggccgttcatggtgagccattccgccatcccttgccgagtcagcgggcttaccacgatctgaccagtggactctttggcgatggcgaacagatcaccgaattcgaatccgatgattgtgtagttggacctggactcgccgacgaaagccagagtttcgatgttgtggtggatatcttggtcttcccagatgtacagcatggttcgctcctcaataaggttgcttttggtgttcgaccagagacataccggccggaactttgaagcggacgtattcgatcatcatcgccgttcgacgccgattcgtgcccgactcgtcattgacgaatagttcgcactggtgcggaatgactcgcgtcaccaggcactcacctttcgagccgtagaacttgctgtaggctgcgacgcctcgcgtcatgttcagacggatcgtttcgcagagtcgctgcgcggccgacgcgctggacagatcggtcggactgaccgtcacccagtaatggccactttgttctttatcggacataagctgccctccaatgagaaagcctctgccgagtcgcagaggctggttgttgttagtcgcgcttcaacagaacgactttgtcatatgcgcgatatttaccgcgccagtcttcccagtagtcgccggccgggcaggtaagctccagggtgatttcgtcgcgccagcattcgacagaaaggacaatcgccttgttcctggctgcggaatccgccctgagcttaatcagaatttcgtcgccagttttcaactcatcaactcttacaacttttgccatggtgttctcctattgggcagcgccgcgagggcggatcgggtcgatgtcatgtaagcagatggtaggatagtccctggccaacttgagcttgaagtccacccagtcagcgccgacaagtgccgagacttcgacacttattttgttgtgcggagcaggactggtgcgcaggactatggcccgacgccgaacgggatcgttgacgtcaacatgagtgagtatttcgtcgccgacgagcaactcacaggccatcaatattttggccatcatacactcctatgagaaggcgcggccaggacgatcccagccgcgccgatggattaacgtttgtgaaggatggacactgcgtccacgtcgaggatgctaatggtacggcgacggcgcggattgctgcgttcatggatgcgaatcaggttcgcagctggagcttcgtccaccacccatacgtcttccggtttctgcgtccggagcaggaccgtcacttcagtattctgggcgaggccgttgcagatgaaagtgaacttggacgagggagttctgtacatttcgagattcctttttggacttctggttcggcttctcagccggtgaagagattatgccctgattctcaccgccgagtaaagcatttgtgtaccaattctcccgtcaggtggaaccaaagtgcggtatcgcttatggctacgctaccgcgccatggcccttcttgctcgcacactgcgaaccacaggctgatttccatccttgccaggactcggccgaaagattcgaacctgcgccgactggacaggatgtcgacattcactcgtcgattgacctcataccggcgaccgttgatgacgaagaccagccgcagggtttgtccgtccagacattcccagtatctggtttcataccgaagccagtagcgcttgccagccgggcctaccatggtcatttaatcgatgctcctggccgcgccacgcggtccggtcggcgggacgggatcgaaccgacccaggatgtagtcgggccggcgcgcttcctgaggacacacggcgagaaggcgccatcctgcgtccagggcagactggagttcgtccgtgcagcagtcttccttgagcagcagacggttgacgttctggagattcggaccaggtatggccgatcctgtgagtgagttccaaccctcgattccactcaccatctccggttggttgatgtagcttacggacataccggccaaccggctcgcggccagctccagacgctccagcatgggtcgcagagcagcttccgggtcaatgtcgtcccagagaaggaccaggctgatgatggtatacggatagtccttgtccagatcccaggctgaagcggtcagacggcccaggccgatttcattacacatcacgggaacgtcgttgctccaggtggacggctcccagttccgctcaccaggattcccgattgttacgccttccaggttccccaggagaacgtggagcttgctgacatattccgcctccaaggctttccgctcttcgtcggtcttgttgtggcgatagaaggatggagggctgactttggcatggtagagtttcataactgttcctcggttttggaagatttgaaagttagagaatggtgtcgcagtatttctcgaaaggactctggcgcttcttctcgcagatcgcgcaggtgatttccaggtcgggcagctcgctgtaagtcttgccgagatacagccagcgcttgcacagactgcggccgtccgacgtgaagaagtggactttgcgagcattgccgggttgcgcccagccgcttggtgccggcttcctgctcataccatcaccacgtcaatttcgtcggcgaagaagttaaagccaactccatctgcgtagccagtgtaacgcagacgaatcgtcccatcaatgtgggcttcctcgacgccgatgacttccagggtggtatcgttgcagtacagcttgacgaacatcttgatgccggagccaatcgccgcgaaggcgatctgcttgtacaggtcttgcttgatcatgctttacgctcctgtttgcggatgtattctgccctgacttcggcttcgaacttcgcccagagcgcgttgtctactggaccccagggaccggtctgagttccgtccaccggttcgaacttgccaccggcgcggcgatatttggacagagttttcaggctgatgatcttctcatcttgggaatcgaattggacgatcatttgacgtacttcccgaagtagcaggtgtggatgatttccagaccattggagatagccttcagcttgatgccgaaattcttgatcgcccagtccagatcgtggtgatagaactcgatgatgttgacgatttgaccggcgctgtagtggatgacgcgaaccttgccgttccagcggaagtcttcgcggctgtttacggcctcgactgcgatggtgtcgtttctgccgatgttccatttggagctagtcatgtcgcaatcctctttttggagtgtttcgcgtttcgatgaggtaactatacctcagtcacctcatcgagtaaagcacttttgaacatattatctgaaatttctgtgagacggatccatcggcggattcagtcagtggaaccgagactccatccgttgcgggcgaaggccgagcgaccagacagcttgcggcactggatggagctgccatcgtcgaaggtgtaagatacggcccagtccaggcgctcgcgacgcactgacgccgcagcgatatcttccagacgggctttgagaagctgttctgctttggtcatttcgagttcctctttggggcgcttcgtgtttcgatgagatgactataactcagtcacctcatcgagtaaagcgcttctgaggaattatctgaagtttctggaggccagaaattgccgccagagccagtcaacgtgatcgttgaggtagcgctcgccatcggacgacagagccaggcatccatcctttatgccgagcttggaactggaaatccattcgaactcgaactggagcgttcctgggcgagggatatgggacaggctgtacttttgcacggtcaggaatcctctaaaggtttggagttcgcgatggacgcgactttctgcatgccgatgcgatagaattcggcctcttccctggccttggccagctgctccctggcttcgcacgccagcttgtgctggttattggcattctggatgcttccgtccagactcctgtccaactcttcccgaagagccttctgcgacgctagctcggcctccaaatcctggattctgatctgaagctggcgattcctttcagaaacatcgttttcgcgagcgatggaattctgaaggcattcgtcaaggcgagtattttcgcgcaccagttgatgcttttctactttcgcctttctgcacgtctctcgcattgctgaaagctcactcgcatgcagatcgtcatccgggtctttacgctcttccttcgactccatccgcaggtagtactggccggctgcgaaggcgagcactgcctggtcggcatacgctgcggcatcggtcatgtatctggatttgtagcgaggcagaaacttgcactcctctggatcccagaggagactatcggcaataggccagaatttgcggaaaccatcaggatcgacttctacattgaccatttgcagctggccggcctccacttcgacttccagaggaacctgaatagtgccggtgatgtactggaagtacactatgctagacataacacaaactccatgagaagtcgcggccgggaccatcctggccgcgcatcgtaatcaatcttcgccttcgtccgcgctcagccactcttcgaaggcgaagtttaccttcgactcgacccaatcctgaagctcatcggcgaactcgtcactgtcgatgtccatggtgatgcccatgacttccatgttccatagcgcggcattcagttcaaactgcaccatccgctcgccatcgacttccataaggatgcggtctgcgacttcatagtcgtctacatcgaacaggtggccgccagtcaggaggtgctggacgaaagcttcatcgaggttggtgacttcgatctggacttgtttggtcattttctgcgatcctctgttttggagtttgggcgcccggcgaaccggggcagggtgtttagcgcggagagtgccgatcttccaattttcgagctcgtcttgcgctgcgatctcaatatctaacagcgcttcctgccgctcgcctgccgctcgcctgcggtaagggtagagttccaagccaaatccttgatggccttgatgatttccttctttgtcatggtcatgcccgtggctcctatgtgcggcgggttggttaggcgaacagaaggcgattgacagcagcgtccacgtcccagccgcaagcgaacagcgccatcgcggcttcgtattcggttgcaaagccggtgtctgccatgaccacttcaacggcggttttgctgtaatgctttgaaagtttcagggcggcgagagagtccgctttgtcggccacagcacaagcctcttgaacagtttcaaatcggcccacctctttgcagcgattttccagaacggcccagccaaagacgttaccagcgccatcagtgattttgtgtactgtgttcatcgtcttaccctccaggtgtttgttcgtttcgatgaggagattatgccgatagtcagaatggaagtaaagtgtctgagtgagaaaaattctgcacaccgacgaacggttgtgctcgaccgtctgctgcggtgtcgatatactcggcctattgcgaacaatggactgattaaatgtacaaactcaatcctgcgctgcgagcggtctggcgaactcgtgcccgttacaaagtcatctatggcggccgggcgtcttcgaagtcacacgacgcaggcggtatcgccgttttcctcgcggccaactacaagctaaagttcctctgtgctcgccagtttcagaaccgcatcagcgaatcggtctacacgttgatcaaggacaagatcgaaaactcagagtataatggcgaattcatcttcaccaagaactctatcaagcacaagagtaccgggtcagagttcctattctatgggatcgcccgtaacctgtcggaaatcaagtccaccgaaggcatcgacattctctggcttgaggaagctcactatctgacccaggagcaatgggaagtcatcgagccgaccatccggaaagagaactcagaaatctggatcatcttcaacccgaacgaagtgaccgacttcgtgtatcagaacttcgtggtcaagccaccgaaagattcctgcgtcaagatgatcaactggaatgaaaatccgttcctcagtgagacgatgctcaaagtcattcacgaagcatatgagcgcgaccgggagcaggccgagcacatttatggcggaattccgaagactggtggcgacaaatccgtcatcaatctcaagttcattcttgcggccatcgacgcccacaagaaactcggctgggagccggccggatcgaagcgcatcggcttcgacgttgcggacgacggcgaggatgcgaacgcaactacgctcatgcacggcaacgtcattatggaagtggacgaatgggacggcctggaagatgaactgctcaagtcgtccagccgcgtttacaacctggcgaagatgaaaggcgcctcggtcacttatgactccatcggcgtcggcgctcacgtcggatcgaagttcgccgagttgaacgatgccagtcccgacttcaaactgatctatgatccattcaacgcgggcggcgctgtcgataagcctgatgatatctacatgaagctgccgcacacgacgatcaagaacaaagaccacttcagcaacatcaaggcgcagaagtgggaagaagtcgcgacccgattccggaagacttatgaagcggttgagcatggaaaggtttatcccttcgacgaattgatttcgatcaactctgaaacgattcacccggacaaactaaatcaactgtgtatcgaactttcgtcgccgcgcaaagacctggacatgaacggccggttcaaagtcgagtccaagaaggatatgcgcgagaaacgcaagatcaagtcgccgaacatcgctgactcggtgattatgtcggccattctgccgatccggaagcccaaaggtttcttcgacttctaaacacagaaaagcccggatcgctccgggcttcgggtcttactcggtgtggttcctggcgctgagtgtcgacgcaacggcctcgccgactcccagggcttcctggccggccgcgagcgcttcggcttccgactcgacgatgaagtcatcaccttggccgtcgcctggcggaacctcgaccagcacggcttcttcgccttcgaaccgcaggtcataagtcttttcgacggacagtccgtaacgggcattgagcgcatcccagagctgagcttcatagttgcgcaggtcttgcagagatttctggtggctgagcatcgccatatcgacggcccgttgcagggtttcgtccaggacgttgaatcgcatgcgaagagaacgaatccgctcgaccacttccgcatccactacatgtctttcgatcatcgcttttcacctttgctgaatgttacgttgtagccattgtcggccaggtaggtcagggcgccttcgaaggaagttccgacgagatgcttgagctgcatttcgcgttgcgcggcgatccagaatgccgttccggagaactctgcgtggccttccgacaataccttgccatcaggcccgtcgatccgaacgtgaacggaagatagcttcagtaccatcaatgaatccctccactggcttgcgacggcatgctttcagcgcgagcggcttcacagtccgggcagggacaggcttggcggacgcgctccaactcgtcggcatccatgacatagagcttcccatcggaagtgtcgtgcgccatggcgatgttcgggaagtcggcagcgctcaggccggcgacagcgcggatttcgtcccagagcgccacatgctcggcattcaggcgagctgcgagcgcttcgtgctctttcgctacacgagccatgaactcgtccatccggaatgcgaattccgcatcgatggatcgggccgaggccatggagttgaggcgaatcggttctttcttcatggtaattctcttttggttggcggttgttcgctgctcaggcctattacagtctgagcagcatgatgaagatgaacgcaaggaacgcaaacggcacaagtatgccggacatcagctttgacaggcgctgcatctcagcgtatttctcggttgacattccgtgctgcgccgcctcagctgcgaagcgggctttcgcctcgataacttccgggcgcagcgacaggacatattctaaggcctcttcccgcgctttttcggcctcgaccgacctagggtcgcgggccgagacttcgctgtgccctggcctcgcgggatgggcctgcagcgatggaggaagttcggcggccacgactccatagtcggcgcaggcccaagcgatcccgatgaggatcgcgaggatggattggacgattcgcagcataactttgtcgctagggaagctcatgatcaatcctccacagaccgaacgatttccaggttgcgcccggcattggtcccggcattgaaggcgcgccgaccgtcgctatcgtccaggcgcatgagcttggtaacatttgacttcttgtagccaggatcgccgaaatgttcgtgcaccgcagcttccttcaccacaaccagagacgttccggcagaagataccagctccatgcgcttcctggtgatggcctgaaggcgatagctgatttcctgggtcgcggccagcttgaattgcgcggcaaccttgacgttgaatcgtccgtatccttgagccttctgatactcccggcacagacgatcaaccgcttcgacaagggagttgaacatgttcaccgccagctcaacgtccgatttgtagcctttaaagcggacggcatgcccccagcgcttcgtagtcccgccgtttgcggcgtgccaagaagccttggcggtcgctcggtgatcgttgatgccaccggcgaaatccatgatgcagtcgttgtacgtcgccacggccaccgagaagaacttcatccagttcgggattgcggaatagtaacgagtcgcgatctgctcatcgaactcttcgcgaatctcgccggtcacttcgaagtcgtgaaggtcatatttgtccttcagcttcttcacacgctcggctgcaatggcggcttcgtgcgggctggaggagtcggccgccatggcagtcagtttgcggatgcggtctttcgccttctcgatggcttccggggtgaattcgttctggtcggtcatggtcggttcctttgtctgaagggtttcgcgtttcaatggagctattctgccttcattcagaattgaagtaaagcactttcttccactatttcggcatcgactggaagaaattccagatccaatcacctgctaccagcaagaggatgagggcggcaaagaacaagacagcggccgcgagctgtgcgcccggcttcagtttgggatggctgagcttgggctctacgggaacggccggagcgctagcgctgcaaccggcgtctcctgggccgtagccgatgccgcgttcacacgcctggagcgacaccagggatttaagatactcggtctgcttttgcgactcttcgtagatgccggcgacggcgaaccagagggcgaacactacggacgtacacacaacccaggcgccggtcagcaggagggccagcgggccgatgacgaagacggtagcagccaggacgattgcgccgccccagatgatgaagccggccagaccattagtgatgtcgacacagaactttttcattttcagattccttcggttacgggatggaggggatttgaaactctgcgccgccgagaacatcaatgacgacttcccagagcgtcggaacagaccactggtaacggtcgaagtcggtttcaggatcgacgcccagcgtcacataggaagtggcaggccatttatgaacactgcctttccgcatgagagtcgccacgcggccgtcaccgagcggattcgttctgtgcggaacgtacgcagacatcgaatattgctgcccggcgtcgacaacaaatctttgcctctggcgcagacatacagagcccacaggattccagccgcgaccgccgcaagcctggcgagccgaagagtgttcataaccttcgtgagtcatttcgccgaggcaagccgagcgatcctcgtaatagttgatgttctccatcgatccaaccagtaccagagactcgaaatcgaatctatgatcgtggatggccgagtgattgaagcaaagccggcgcggcaactccgggtgccaaacatggaggcgccctgccgggagctggacttgaatgaaccccaggccgtgcagcgtgatcttgtccttcatcgggtcatggacggtgctcatggataatcctcagtagcagaaatgtatggtgagagttacgatggccaagccggtcgcccataggagggcgaaccaggccatggctttgatggttatgtagatcatccgaagaactttccggcacagatcggtccaatgcccatttcgatggatgcgtggttggtcaactcgcgaccgcagcaggagcattgaccagtcttccggccgtaggcgactgccgattccatcggcttttcaaacatcttcagaacgtcgtcatgctcagtgtcggtgcagtcgcgactcttgatgaatttgccattggtgatccggccgaggtagatgtcgcccaagacgtacaagctaccggcgttccggctgtgagcgctagcctctttcacaataacgatgagcggctcctcgccttcgccagccaggcggattttcgggcgcttgatgccagattctttcgccttctcaaacgccttctcgatgccggaaatgtccagagtcggtgcagcagcttcctgcgcggccactttctcgcgatatttggcgaggttttcgatggcgcgcttcgcagcagcgatctgattttctgtcaaggagccgtatttatacaacgactcctgaaggctctgagcgaagctgaaggaatttccagtccaccactcgacgatgtccgggtgcgcagcttcgaaggctttaattttgaggtcgcgctcttgcgcagcgctacatattttctcgatgcgcttttctgccgccttagcacgactcttggcgcgctgctccgggctggttttgtactctttgtatccaacaccgccgcaggcgaagcaggcgcgaccataagacgaagggccacggtacaggccggtgcctgcgcatttggtgcacttgtcgcgatacagcttcacttccttccgggaattcgggcgagcgcccatggacgcgtcttccagggtcttcggcgcttcgttgttgatcgctacggtagcgaagtcgtcacccaggtcttcgaagccggtgaacagattctctgctgcgttcatatcgattctcctgtttggaaagttcgtttcgatgggttgactatacgccagaaatggaaaacggtagcactttcgcactaccgttcgtcggatcgcagagggtcaggctacacggatcaactgcgacatgactgccaggttccgctcggcgacgccgatgatgacgttggttccgatgatgaacttccaagggtcttccctgttcttgtcgtagaacggatttctgaacagggtccgccatgtctcttcagtgaagaacgttttatggtccaggtcttggtgggcgatgttggagttgtagaatggaacaacgacattgagcgtcgcgccgactgccatggcccgctgcaggtctttcaccaaatcgatgacctgggctccggtgagatgttcgaagaagtgaaatgcgtagaccgccgtcaattcgccgtcttcatacggcactcggccgctggcgccgtcccagttcggccagtcgagcgattcgacgccgggaatcggcgaattgcctgcgcccaggtttactgcgcggcggtgatccggctcgatcaactgagcgatgtcgcgcttcatgccgagtttgaacaggttttgaatatccatttggttctccaggttgctgttagtaaatgtcgctgttgatcttgaatccatgctcagcgccgtcgttgtggtcgtactcagcatagctgtcgcagtagtcattcaaatgctgaatgatgccaagaacgtcgttcgcggccttgtgccgtttcgcggcgatggtcttggcgatgttgtcgccgacttccagggtttcggccgtccggcgatggatcagcaggcgactccaaagatagagccggacgcgacgaatgatgtcgcgatggcgctccagtcgtccgtgcaactcttcaatttcgtgctcgcgagattttaatactcgtcgaagctgctgaacttctaattccaaatcggccttagtagccatgttcacctcaaaaaggaaaatcgtctgggactccaggaagctcgacgactattgttgagcctgatcgatctagaatgcatccgaccgagccagccctgtggggatagggtctacacgaactataacaggtgacttccatgactattcgccaggtcgatcctccacaccatctacaaattggcggtcgcttcgacttcagttttcgttcgtccaagacggcgcgtctgtcgcaggaaaggcagcgcgccttaaccgacgtaaccatgggtatagtcgatcattcggatgaggccatcatcctctgattccctcgacttcagaccgcccaaagagtccgactggccgttgcatttcgcatcgatatccatcgaagacaagaatcctgccgatactacggtgatatcaactttgtcgccggccttcttgaagtcttcgcactcagcatcgagggccacaaccgcactcgcagccatgttcacatgacttatgaggtcggggaagatcacaggaacttcacgcgacatgccacggaccgtcatcttcagtactacatacttcatactcactatcccttttgtatgtgaggaaagaatttgctgttttccggatggtggaagcgctcggccgcaggctgtctttcttccggacattgaatcgtcgaaggcgggaaaaccgcgccggcgataatcgccgcgaggagtgcagcggatgtcgacatccagagggcggtttccaggctcacccgaacttccggacggcgcggcttcattcgctccaccctcttcccggttcataggatggtagactgccgccgcgaacccagtcgtcccacatgtggttcagaccagtcggtggctggggcggcggactgtagaatccgggagtctcagtgctgctcaggaaataaggtgtgcaaacggcctggacggccagttggtgccgctcccacatcttatcaatcgctcttagcatgacgtcttcgcactgagtcttactgtcgaaccgtctgctagtatggtccggtatctggacacatccgtctccagtgcaaaggaaagcagtagcaatccatacggtgatactcgccatttcgtcacctctttagttgatgagcagagtctattccatctgctcgccaggagtaaagcgcttttcgtcgggataaatgccgatgatgtctgcgtcgagcatccaaatgtccacggacggatcgtcgctgctgatttgatatagattgtacagctcccgtccgcctacagcacgctcgcctcgcggctcaaccgccagaaccttgccgtggccttctccgtgctcgtccaggtatatgacgtgatcaccgacttcatagctttctttcgtgacgaggcgtgaacgcgagttgttctgcgattcaaccacccaggaatccagcacgccgcctttcatgtcgcggaacaatcttgccgatttgtcgcaatcgaacacgcccagaacttcgccgtctttcaacacgatgtgtacgataggaagaagagtattcatgtttaatctccattgactgataattagagtctaatctgccgaaaagttcccgtaaagaattatttctcagaactgattagttgtaactgttaatctgatgtatgtgtttgaatctcttttgaacgtttgatgtttcccctataataagcgcacacagccaacaaccacgtggaactacaatgtttaaactttcctggatattcgggcgcaaaaaggatagtgctgcctgttctgaatcggcgccggagaaagtcgcacaaatccctcaacacgatccgctcgaccctatgattaagctgggcagaattcgcggctggaacgtcgagccggagaaagccccggtcatccgtagcgtgaaggattttctggaaccgggcctatccgtcgcaatggacagcgcgtatggtgacggaccgactccggccgcgaaggttgctgcgggcggccagaatccctatgtcgtcccgaccatgctgcaggattggtacaactcccaaggtttcatcggacaccaagcttgcgccatcatttcccagcactggttggtagacaaggcttgttccatgtccggcgaagacgccgcacggaacggatgggaactcaagtcggacggccggaagctatccgatgaacaaagcgcgctgatcgcccggcgcgacatggagttccgcgtcaaagacaaccttgtcgagctgaaccgattcaaaaacgtcttcggcgttcgtatcgcactgttcgtcgtggagtccgacgatccggactactatgagaaaccgttcaatccggatggaatcacgcccggctcctacaagggaatctcccaggtcgatccatattgggcgatgccgcagcttactgctgcctcgacggccgatccgtctgccgaacatttctatgagccggatttctggatcatcagcgggaagaagtatcaccgcagtcacctggtcgtcgttcgtggaccgcagccgccagatatcctgaagcccacatatctattcggcggcatcccgctcacccagagaatctatgagcgcgtgtatgcagcggaacggacggcgaacgaagccccgctgcttgccatgtcgaagcgaaccagcaccattcacgttgacgtggaaaaggccatcgcgaatgaagacgctttcaatgctcgcctggcgttctggatcgccaaccgtgataaccacggcgtgaaagttctgggaattgacgaaggcatggagcagttcgacacgaacctggccgacttcgacagcatcattatgaaccaatatcagctggtcgcggccatcgccaagactccagccacgaagctcctcggcacttctccaaaaggattcaacgccactggtgagcacgaaacgatttcttatcacgaagaactggaatccattcaagagcacatattcgacccacttctcgaacgtcactatttgcttctggcgaagtcggaagaaatcgatgtgcagctggaaatcgtctggaatcctgtagactccacgtccagccagcaacaagccgaattgaacaacaagaaggccgctaccgacgaaatctacatcaactctggcgttgtgtctccggatgaagttcgcgagcgtctgcgcgacgatccgcgttccggctacaaccgactcaccgacgatcaggcagaaaccgaaccgggcatgtctccggaaaacctggccgaattcgagaaggccggtgcacagtcggtcaaggcgaaaggcgaagccgagcgagccgaagcccaggcgggagccgtagagggcgcaggcggcccggttcccgccgctccacgcgcgactaagcctctcgcgaaggcggccgaggaaggggccagcgaggccgctgaaccgccgtcgcggccggaccccaaggccgagctgcggaacttgttggtcgatcttttgtcgaagctccaagacctggacgacattaaggcgccggacggcgtagacatagagcacaatgatgcgcctggcttaaagcgcacgtccaaacctggcgtgtctggcatggagccttcagtgttttcgtccaaccgcatcgtcgggcctcgtgatcattcggaactccagagaatcaaggtgaatggaataaccaccttgatcgaaaatccgcgaggaagcattcgacaaggaaaggatgggagttggcgagttcagatgaaacaccactacgggttcatcaagggaacgaaaggcgctgatggggatgaagtcgattgcttcgtcggtccgaatctgggatccaaacgggtcttcgtcgtcaaccaggtgaacaaggaaggtcagtttgacgagcacaagtgcatgctcggcttcaacaacatcaacgatgcgaagtccggatatctgtcctgcttccgtccgggctgggatggtctcggctccatccatgaagttgacctgcccgctttccgtcgctggctggcgaacggcgacaccaccaaaccattcgggggcgagtgatggcattcaaggcctccaaaaagcgcgagcgccgggcacctcttccagtcggaagagggaagcccataattccatcggcaggaatcgaggcctggtatcgaaagcagatgaaggatatgtccaagctcatgatctccgactatcgaaacgagattgagaaggcgctgtcccagcctgcggccgaacggttcttcgccagagacgaatccgttaacgtcctgttcaagatgacccttcgaagcctacagcagcgatggagccgcatttttgaaggtttcgcggccaagatcgccccagagttcgtcaaccggaccgaagaagccgccactgccgcgacccttcacagcttgtcggtggccggcgtcgatcagccacgagctgcgtataatgagagcgtcaggaacaccctggaggccgcaaccacttacaatcatactctcatcaccaagatccaagaggaagtccacgagaagatttacacatcagtaatgctgtctctgacttccccgaatccggaagagcaaggaacttccggcataactaacgcacttcgcaaagtcgggaagttttctgaagatcgaatcgaactcatcgcaagagatcaaacaagcaagctttacagttctctgagcgatgagagaatggcggaaaatggagtcgaggagttcgagtggctacactcttctgccggcaagactcctcgccacacccacctggagaaagatgggaagaggttcaagctgaatgaccccagactttgggagggtccgaaagcagaccaggggccgccaggatgggcgattaactgtagatgcagaaagataccagtcatttgacgtcgataggagcgctatatgccgttagttcatggcacttccaatgaggctcgttctgaaaacatcaagcgggaaatcgaagccggtaaagacccaaagcaggctgcggccatcgcttattccatccagcgcagtgagaaagggaagacggcgaaagattgttcgcctgagctcgtcgccgatcttcgcgccctggtggacgctctgtcgaggctcgtgaaatgaaccgcaagacgtgccggcgccgactcgtggtcgatgtaatcagggccaatattcacggcggattcttcagcctgaagtttgccgccatcgatttggcaatcatcggcttcgccatcttgatggcttttggccgatgatgctgagaaaatctggattctgactaaaaattctagtccggatagccgcaaattaccgtttacggaaaatggcagtaatttggaaatcctactgccgcgaggctttaacagagccagttcctaatttccgatttagccgcatgcttcaaaagtatatagcctgggaaattagaagtaacgttccaatagaattcatctataagcaacgttataatataacgtcaatctatatgctctagacgtattgaaattcaatttttaatcggtaaattggtaatttgaattagtttagaagttgaaagtctcgcggcagtaggcttagacaaatcccgtcaagtttccgagaccaaattaccggattttcgcggctgaggaaactggtaattagatcataatacaaattataatgtaagttaacagtcgcggctacatctaattattgttccgcttatttacccttagatgtactgcgtatataatacagccatagtccacgactcttcgaattaacgatggcaaagtcgaaaagaaaaattgacgaaaatggatatatgaccatagagggctgcccgatcagctcttatggcgttttccaatattctgctggtcaactcggtcttccgggcgatccgacgcggattgtcaacgtatatcgcccggagtctgccgtcagcgatccggagtacatcgaatctctgaagaatctcccgttgatcgacgagcatgagatgctgtcgggattcgacgatgatgacgatagcgtggcccccgaagacaaaggggtggagggcatcatcacatccaacgcttactacgaagccccatgggcacgcggcgatatccgcatctattcccgcaacatgcagaatcagctggaaaggggcaaagaagacctgtccctaggctatagttgccgctacactgagcaacccggcatctggaacggaacgccttatgaagtcgtccaggacaagatgcgcggcaaccacattgccctggtaaaagagggtcgtgtgccgggggccagagtattggatggtctgtgttttgaccatctcagttttgatttcagaccatccgatgagggtaatgaaatgagtctcaagaaagccaagcggaagccccctgtccagcgcgtagggcaagctgctgactcggcggtcgaagagttgcgcgccctgtggccgaagctatctgcgtctgtccagaagttcctgggcgaagaagagcaggagccggagcatcaggaaggcgcagctccggccgaaccgaccgacagcgagcacctgaccgagcatccgactctggaaggtgctcagaaggatgacgaagagcaggaagaggagccttccgttgtcgatccggccgtggccgccgtcgagccggagcatcaagaaggtgccgcatccgaaatgtccggtgaaggcgaagtcgccgaactgatctctcaagtcaaggccattctggctcgactggagggcacggtagccgaaggggcggacgaagagcatggcgaaggtcaagatgtcgtcgagggcttggaagagcagagcagcctcagcggcgcgcaaaccgccagcgacgatggtggtgagggcaaggataacagcgaggaacttcctgaaatggcacagaagaacgcgcaagatgctgcaattcgcggtctctatcgcgacattgctgctaaagatcgcctctacaagcgtcttagctccgtggttggtgcgttcgatcaccgagctatggactcggctgaagtcgctgtttacggcgtgaagaagctgaatatcagctgcgcgaagggccaggaagcactggcgctcgacatgtacctgaaaggtgtcgaagccgcgcgcggcgcggccagccgtcaatcgaaagcccaggattcggccggttctgctccgcagtgcgccgagctggacagctacctgaagggggagtaactcatgttccagaaacaagtttaccgccagtacactcctggttttccgggcgatctgatcgaggacggcccgaagcgggcgcggccgggtcgaatcatgtctctgtctgccgtaaatccggctgccaccgccaccggccccaaccgcatcagtcgcgctttcggttacgccggtgacgtcagctccctcggcgaaggtcagccgaagactatcgcggctcgcgcttctgaagtcgtgatcggcggcgccaacttctttggtgtcctcggtcatccgaagcactatgcgctgttcggttcggccggagactccctggctcccagctatgatctgcccgatggcgccgaaggcgagttcttcgacatggccaccggcctggtcgtcgaaattttcaacggcgccgcaaccgccctggacctggactatggtgacctggtcgcctatgtaccaaacaacctgcctaccgccgacaacgcgcttggcctgccggccggcgccctggttggcttcaaggctggctccatgccgaccggcttggtccagattcccaacgcacgcatcgttaacgccatcagtctgccggcccagtcggcggggaatctggttgctggcgttaccatcgtccagctcacgcagtaaggaggcgtcatgagccagatcagcaagacccattcgcgcctcgcaggccgcaatgcgaaacctttcgacctgaaaaacatcaccaatgacgccgtggcgtctctgcgccgcatcggcctggtattcgatcacgccgtcgtccaggaccagatcaaggccttggcgaaggccggcgcgttccgctccggctcggccatggacagcaacttcaccgccccggtgaccacgccgtccatcccgactcccatccagttcctgcagacctggttgccgggcttcgtgaaggttatgaccgctgcacggaagatcgacgaaatcatcggcatcgataccgttggctcctgggaagatcaagaaatcgtccagggcatcgtggagccggccggcactgcggtggaatacggcgaccacaccaacatcccgctgaccagctggaacgccaacttcgaacgtcgcaccatcgttcgtggcgagctgggtatgatggtgggcaccctggaagagggtcgtgcctcggccatccggctgaacagcgccgaaaccaaacgccaacaggcggccatcggtctggaaatcttccgcaacgccatcggcttttatggctggcagagcggcctgggcaaccgcacctatggtttcctgaacgatcccaacctgccggcattccagaccccgccgagccagggctggtccactgccgactgggcaggcatcatcggcgacatccgcgaggccgttcgccagctgcgtattcagagccaagatcagatcgatccgaaggcggaaaagatcactctggccctggccaccagcaaggtggactacctgtcggtaaccacgccttacggcatttcggtttcggactggatcgaacagacctatccgaaaatgcggatcgtgtcggctccggaattgtccggcgtccagatgaaaaaccaagagccggaagatgctctggtgctcttcgtcgaagacgtgaacgcggccgtcgatggcagcaccgatggcggcagcgtgttcagccagctggtacagagcaagttcatcaccctgggtgtcgaaaagcgggcgaagtcgtacgtggaagacttctccaacggcaccgccggtgcgctgtgcaagcgtccgtgggctgtggtgcgctacctcggcatctaacagatgcctattcaccaaaggccgggcttccggcctttgttcactctgactctaactcggttgtaggggccggttagggcataattactaggactacgccaatgactgtttatatcgtttcctccatgactcaatcggtgtcttacaatgcgtatgacacctctgatccgtccaatcctcgcctccagcgaaagattctgattcgcggccgcgcaggcatcgcatccgaaacttccggcttcggcgacatgatttccgacgaggcaggacgtccgatctggaccccacagggcgattgcactgccgtgagcgattcggatttcgagctgcttcaggccaataagattttcatgcgtcacatggagaagggttatctgcgagtcgtgaagaccgacatcaccagtgaccaccagcggatttccaaagagactcgcaccatggagcgcgatggattccagcctctggatgctactcgcctgcagcagaaaatcaaggtgaccacagccagcgcttcccaggaacaagagttccggatttaaccgagggtttcggtatggtgattttcgacgaaaataagtttcgcacgctgtttccggagtttgctgatccagccgcttatccggacgtgcgcctgcagatgtatttcgacattgcgtgcgaattcatttctgatcgcgattcgccataccggattctcaatggcaaagccctggaagcgtgcctgtatcttctgaccgcccacctcctgtcgctgtccacgatgcaagttcagggcgcggctggaggtggcgtcaccgccggtggaacccaaggcggtttcatcaccagcgctacggtcggcgaggtcagcgtggccaagctcgcgcccccggccaagaatggttggcagtggtggctttccgggacgccttatggccaagagttgtgggcgctcctcagcgtcaaagcggtgggcggattctacatcggcggtcttccagagcgccgaggcttccggaaggttggagggacgttctggtgatccctggtgcgaatcttctgcgaatggccttcggggtcatcggtactcaaattgtgaaatatcgcaagtttgagcagcgagtgaagaatgatcaagcccagtatgtctccatgttcggggagcctttcgacctggcagcgtctgtccagcgagtccgacgcgatcagtatgcccagtttaatctggagttccaacggaattatgttatgatcttcgccaactttgatatggttgacttggatcgcaatatggccggtgaccagttcctctggactggaagagtttttcagctggagtctcaaggctcctggttttatcaggacggctggggagtttgcctggccgtggatatcggtgcggccaagttcaccgatgacgggaaaccgactttctaggtggtgtatgtttgacggcgaactgatagcgaaaatggttgtcgagctgaatgcggcgatggcatctgctcaagaggctttgcagttcccggattttgaagtcgtccagaaagctcagccgacccaacaggggacgtcaaccaggccgaccatctttttccagaaactgtttgacattcctcgcggctggcctgccaccgattggtacctggacaacacggcccgcaaatatgtggaaataactcgacagcatgtagagacgactttccagatcagttcccttcattggcagaatcctgaaatcactcacgtggttacggcttctgatatcgccaactatgtgagagcttatttccaagctcgatccacaattgagcgcgtaaaggaactggacttcctcattcttcgcgtgtctcaaatttccaacgaggcattcgagaacgacaatcaccagttcgaattccacccaagttttgacatggttgtcacttacaaccaatatattcgcctgtacgaaaacgcagcatattcggccgatggggtattgataggcatatgagtctgaggcgcgattcagagctaatcgccgcgcacctccagatgttaagagccatgcgcggcaggtccgtttcagccggatggtattccacggctcgatatcctgacaaggcaggcggatcggtcggaatacaagtcgcgagaatcgcacgtctcaatgagtacggcggaactatcgaccatccgggcgggaccaggtatattagggacgccattgttcggggccggtttgttggcgttcggttcgtcagaaacgactttccgggagaaaccgaggtaactaagcctcacagaattaccatcccggctagaccgtttatgcgatatgcttggaacttgttttccgcagatcgcgccgcaatccagaaccggatagccatgaggctggccagaggacagatcactccagatcaagctcttgcccagatcggcctggcattggaaggatacatagccagaagcatcaggaccgggccatgggtggctaactcagcatctacggtcaggagaaagggattcaacagaccgctggtcgatacggcgcacatgcttcaatcgattagcagcagagtaacataaccaggagatcatccagtgatcagtcagagccgttatatccggatcatttcgggcgtaggcgcaggcgctccggtcgcaggccgaaagctgattctgcgcgtcatgactaccaacaacgtcatcccgcccggaatcgtcatcgagttcgacaacgccaacgcagtcctgtcatacttcggcgcgcagtcggaagagtatcagcgggctgcggcttatttcaagttcatcagtaaaagcgtgaattcgccgtccagcatcagcttcgctcgctgggtaaacaccgccatcgcgccgatggttgttggtgacaatctgccgaagaccatcgccgatttcgccggcttctcagcaggggttctgaccatcatggtcggcgcggccgaacagaacatcaccgccatcgatacgtccgccgcgacttctatggacaacgtggcgtcgatcatccagaccgaaatccgcaagaacgctgacccgcagctggcccaggctaccgttacctggaatcagaacaccaaccagttcaccttggtcggcgccaccattggcaccggcgttctggccgtggcgaaatctgccgacccccaggacatgtccactgccctcggctggtccacctccaacgtcgtcaacgtcgccggccaggctgccgatcttcccgacgcggccgttgccaagagcaccaatgtcagcaacaacttcggttcgttcctgttcgccggtgcgccgctcgacaatgaccagatcaaggccgtgtcggcctggaacgcggctcagaacaaccagttcatctacacggtcgctacttccctggcgaacctcggcactcttttcaccttggtgaatggcaacgccgggaccgccctgaacgtgctgtcggcgactgctgccaacgacttcgtggagcagtgccccagcgagattctggccgccaccaactacgatgagccgggcgcttcgcaaaactacatgtactaccaattccctggccgcaacatcaccgtttccgacgataccgttgcgaacaccgtcgacaagagccggggcaactacatcggcgtcacccaggccaatggccagcaactcgcgttctaccagcgcggcattctgtgcggcggtccgaccgatgcggtggacatgaacgtctatgccaacgaaatctggctgaagtcggctatcgctcaagcgctcctggacctgttcctgaacgtcaatgcggttccggcgagcagcactggcgaggcgatgaccctggcggtgctgcagccggttctggacaaggcgactgccaacggcacgttcacctacggcaaggaaatcagcgccgtccagcagcagtacatcacccaagtcaccggtgatcgccgcgcctggcgtcaagtccaaaccctgggttactggatcaacatcaccttctccagctatatcaacagcaacactggcttgaccgagtggaaggccaactacacgctgatctattcgaagggcgatgccatccgcttcgtcgaagggtcggatgtgatgatctaatggtttgcggcggactcgatccgccgcaaccttccataaatggagtgaggaataagcaatgatcaacatttctgcgttcggctcgatctgccagttcacggcaagcagaactttcccgaacggattcaccgtcaccgagttcgccgacgatgccgatcccatcgacagcccgccgttcaccgctgccgataccggcgtcggtctcaacggtgacatggtagtttggaaccgggcgaacatcctggaagtagtcgtcaacgtcattccgaataccgagggcgagcgcaacctggcagtcctgctggatgccaaccgcaccggaaaggacaagtcgggcgctcgtgatgtcgtcggtctggtcgtggcgatgccggacggcagcaaaatcacctgcaccaacggcacccccatcgacggcgttctgatcaacgcggtggcaagcgtcggccgtctgaagaccaagccgtatcggttccgatttgaaaaagtgatcaaagccggtactagctgatgaagaaaattccgctgacagcagtccccaatcaagcgatctcatttaacgccggtagcagctattggaagattcgcctgtaccagaacatggacatgatgaatgccgatatcagtcgcgacggcgtgatcgtttgccatggggcccgctgcttcggcgggattcctcttctccagtacagccatcagtaccgacctgactatggcaatttcgtcttcgaccgcgacgccgattggacgttgttcggcgacggaatcaacctgttctatctggacggcgccgaattcgcagagtatcaggcgctcgccacgaggaaagaatgagcacatcaacgatcagaaccgggacgaacaatgatatccttttggacgacaatggaaacatggtcatcctcaggggtgtcgaagcgtgcgcccaggacgttcgggcggcgatgctcatgcgcaccggcgaaaatattttcgatgtgaactccggcgtgggatatttcgaatacatcttctcgccgcagaaaagctatgatgacgctcgcaaatccatcgcggatgcaattttgtcctcgccggatgtgaccggcatcgagcagctggacatcgacatcaccggggaagtcttcggcgtcgatgcgaaagtcatcaccatccacgggcctgttaccacaggagtttgaaatgagtaccatccgcatccaatacgccaacggcacccaactgttcctggacggcaaaaatccgccgcccctggacccgctgccctcgtttaacccgtctgtcgaagatctggaaggcctgggccgcgaaaagaacaccgacaagggcgactcctcgccggccggtcttcccgttcccccggtagacgtcgattccaatgtcgacaacggcggaaccatcccggctccggtatcgaccgacgctcctgcggccgaatcggccccggaaggcgcccaggaagctcctgcagcaggccaaggcgacgagaaaggcgccgaggaagccccgactaccgccccagtagaaaaggccgaggaaacggcctcgccggccgctgaagaggcaaccccggctcccgccaaggccacctctcgcaaaaccaccagcaagtaaggactcgacatgatcaacgtcagcggcttcggcacaggaattgtaatagtttccgcctcatcgttcccgatggggttttccttgtcgaagttcgctgatgatgagagtccgatatcctccaaagagctggagccgttcggatatgagatgctttatgacggcggcctattcgcctttgacaaggctgctcctctggaagtatctgtatccgtcatcgcagggagcgaggatgatattaaccttcgcatccttctcaattccaaaaagggatcattcagatttcttccgggaatcatcccggacatgacgactctcgtggccactcttcctgatggcggccgcaccgttctgtccaatgggaccatcctcaagggtccggccatcgacaccatacagaacaccggacggcgcaaaggcaacacgtacacttttgttttcggtagctatcttggcgcccagactgcgcgtcaagccatttctaacgttatccaatcggtactggaggtggtctgatgttagggattttcaccagcctcctaagttcgcgatctttttcgattgtggaccaaaacacaaaccagctagttgctgcggatttgaggataagccgggtcaacacccggttttcttctgtaggacaacgccacatgctggaagatggtacgaccaagatggattccagaacgatccaccctatggaaatcatcgtcgaagtattttgcccttcaattggtgtcgtcgatcagatcaatcaattgctcctggatcgcgacacactgtacaaagtcatcactcgcggcatggtattcgaacggatgatgtgtaccagcgaagcgctcaatcagactccggatgtgatatcggcgactcctgcacggctgacattctcccaagttctcgtccagaatcccaagcctataatgttccgaaatgcaggggactcttctatgatcgaccgagggctggccctagctgaagacgtggttggctcggccggcgatctgttcgactacgcagtgaacggcgtccagaacgccgcagacttgttctgaggtgccaattgaactctttcctcaagtctattctcaacacgcctactctcaccatacgcgatgatgttaccaaacttcctgtctggaagagtcttcaagtcaagaaagtggaaatttactcgccggcttccgtagtgtcgaaacctctggcgacgaaagaccagacggaagctcaagtgtacaccgaagctctggacattgatgtgaagaatggaaagatcatccaaccggtgcgactccgcatcaatgctatctgtccggacctgtccaccgttgaaagtatcatgaacgctttcaatgataacacctcgactttcgctatcacttctaagtcgatattggccgataaaatggccatcatgacgctcgatgtagatcagtctccagacatgttgaacgcggctgagatcaatatggaattcgagcaggttgagcctccagtattgaataaattcgatcctgcgttccctcaagatagtccgacttatggggtacagattcaatctctttctgatgctaatttgctggattttggcgccatcggcgattcgatatcttcggccgcaaaatcgctatataatcgcgtgaccagctacttctgaggatgtatcatgcttgaaatcaatcttcccgatggccgtcaaactcgcgtacaaatcgaggcgtggtcggcattggatggctgggaactccagcgccgtttcgtcgaattcgctgtcagccaagattccgacttccgccgctctttcaccatggaaatcctgggctatgcgaaagtgctgcttggcgacgatgacaccggcattccgctgaccaccgcggcagtcatcaacaaccacctcggccactggaagaacgtggaactggttttcaactctgttctcaagcacaatggcatcgacccggccacgcacgccgaccggccggactattgggaacaagtcggatcgcagatggccatcgcatttctggccgaggcgtccaagctcattggtccagcaatgaagatcgccgaaggactcgccaacaagccggagtgattcatgtctagtgatttggatgaattcatacttcggtatgaggccgatactgccagagccgagcgcaatctggagcgcctccagaaccagatcaggcgcgtgaacagcgcatcgacgagtggccttcaggatttgcgccacttcgcagacggcgcggccactgaactcggccgagtcgttccgcagatcgattctgtgacgagcgcgattcgcgggatgaacgcgcaactggcgataggcgccactggcgtggccctggtcgcggccggcgtcaaggcgttcatgaacaccagggaccagtacaatcagcagcgcatccaggcgatggacatcggcatcgccccggcacgcttggaagagtaccagagaaaattcgttcgccagtccggtggaaccatcagccgcgagcagggcgcggagatgaccaaaaatctggcagacactttccggcgtgcttatcgcgatattgggcgagtcggcccggaagcgcgaattctgcgtatggccggcgttgatgtcgggagcttccaaaagggcatgcgcccgctcaacgacatcattactgatctggccacgaaaatggccaagctgaagccggacgaaatttctgcctacgctgatgcccttggcgtctcgcgagactacctgagcaccctggctaagatcggcccggccatgggaaaagtcaccgagatgacgactgcggaactccagtccagggtccagggcgagtccaacattcagaaattcaacgatgctctggcgaatctcaaccagacgttcaccaccctggaaaaccgagtcggcgaaaagctcgcgcctgcgttcaccaagctgatcgaaatcatcgacaagatagtccaggctattcccaatgaagtggaaagcttcgcgaaggacaccaaatcccgttgggaagatggagtgctcgggaaggcgaccgttggcagtgatatcctatccctcctcagccccggcgccctgctcggtcgcctggcagcgtgggggactcgtcgcggcatggaagaatcagggctcatcgacaaggacaaggttcccggcgctcaaaccagcgaagacctggccaagaaacaagaagaccaggacaaggctactaagtccatgaaagagctagagaagctggctgaccagaccacgaagtctaccaatgattttgcggtggcgatcaacatgttcagtggcgcggtatcgtcgttcgcgaatgccgttgacgagcgccaagcttgggcagcctgggcgggggaaattggtcgggcggtcggtatgggaagcaccgcgccgacttcgcgggcaaccggcgtctatccgcacgcgatctatgatcagtcgaagagtggcgcggccggacaagtcttcggcgagccaatcggcgcccagtctcttcgcaatcgcatgttctcgccgcagcgcaaggcagagccggtcaccgttccatcgtacatcaacgatatcatcaaagatgcttcgaagatgtacaacattcctgagctggacatcaagaaactcatatacaccgaaagccgattcaacgccagggccaccagcgaagccggagcgaaaggcctcatgcaactgatgccggaaatcgccaaggcgtatggtatcactgacgtatatgaccctcgccagaacatcctcggcggaacgcgcctactgcgtgaaaacctagatcgagcaaatggcgacatgcggttggccttgacatactatcatggcggactcgatccgaagaactggggcccaaggactcgcgcatatccgggtttggtaatgagcgctccaatcgagctgatggaagaggctcagcgcaagcagaaggctgcggccatgaccgtcgccaacgagacgttcgccccggaaggcggcgacatggacattcgtccctatgatggcgggcgactggaaaccccagaccagggcaagaaggaagatgagcgccgcgaagcccgtcgatatgacgacagggttgtgcgaccggaaattcgcatcatcgaccgcatgccagaccgcagcgacggcgaaatcctcaagatgtctagacgtcaagaggccgaccgggcagattctggattccggaagttcccgaatcaagttcgcggcgagaccaagcagaacatccaggctcaactcactgcaggagccatcgcgcaagtgatcggcgttaaccccaaccagatcatgcgccgcgaaatcagccgttctgacttgctgttcggatacaaccaagccatcctgggcaagcaacaggagatcaaggccgccgcgaccgaagccaacaacgtattcctgtctccagccaagcttgccgaagccacggccaaggtgaacgccgcatcgcgagaaatggatattctcaggacgtacggcgagcaacttctgaagagcgctccagagcgcggccaggagctgaccatcggtcggatcgacatgttggtcaacgtcaccggcgcgaattctccggaagaggctcgtgagatattcagcaagcagactgcagaccagctgactacggcaatccaggacgctcaaaacgattccgcaactaagatactctactgatgaaaaagagaattctgcgagtaacattcaacatgccttatggacccgaagtcatccgcgaagatctggatgttcgggtccggattatgaaggctgcgttgcggattcagaaccgggcgacgatggaaattttcggcctcaccactcagctgcgcgagtctcttctgtcgcagttcaccgcgtggaagcaccggcaacgtcaagtgggcagggaagatgaattgatgatcaaggtgtcggtggaagccggctactctgaccaggggcgcgagcaagtttccagagtctttgtcggcgaagttgccattgtcgatatcatttctccgccacctgacattggaatccgcatccagtgctataccaggcaaatcgacaggacgaagaccattcggaatatgccgcccgccaacacgacgtttgtcaagttcgtcgagtggggcgcgaacgaaatggggttgaacttcatctgcgataccagctacaatgatcaagttttgaagaatccgggccgttcgatcactgtcgcgtcggcaatcctggcgtcaattcaggatatgtacatgccggatgtggccgcgttcgtcgatgatgacgttttgatcgtgaaggatcgtgacaaagtcattcgtccggatgaagtcgccaacattaactcattcgtcggcatcccttcatggtcggaatggggtgtggaatttcaatgtctgtttgaaccgtcgattcgcgtggctggcggtgtcgcggtcgaatctctcatgaatccaagcgtcaacggcaactatgtaatcaccgctctagagtatgatttggccagtcgggatcggcctttctatatcaaagtcatggggagtccagcagcgtaatggccagggaaatcaaatcgttcaatatgttcggcgtgcactacaactcgcggcaattctctgcggtcgatggactcaggatgatgtcgggaatccatgatgttccgccggaagaattgctcaaagggaccgacgtgctggcccatacagaggaacaaccggaaggcgtttggcttcccttgatcgctgcgaacataaatctttatgtcattgaccgggcgaacgtaatcgctcccgtacaagtgcttgcgcttttgtctgaactggtcatagattggaactttggcttcctcaaagattggacaggggtcaaaattccagcccgatttgtcgaagatatcaagagtgtaaaaacagcccattcaccttctgtggtcgcaagtttggtggcgaatgggtcagcttctatgcgcgagctggaagaatattattcgactcaagatgcctttaagatgattgacatcatgacggcgaagagcgtgaatgaggctctagcgtccgaagcatcacagaacagaatcaaaaagggataattcctaagcgagcctgggaaggctatactagacctgccaaatcagaggctttcccatgtccaatattcctttaacatcagcaaaatctaccgacagaacgcgactgatcgccgctcttgacgctcggtcgcggcgggacgcgctcgactttgaagtcatgattcccgcccaggttgttcaatatgatcggaccgaaaatatcgctacaatccaacctctcatcacctgggttgatacggaacacaatgccgtccagaggcaccagctggttgatatcccggtgatttccatgggcgctggcggcttccacataagtttcccgatccagcagggggatatcggctggatttacgcggccgaccgcgacacctcccagttcttggagtcgctatcgatgtcgaagccgaacaccggccgcatccacaaatttgagcatggtatgttcataccggacgtattccgccgatataccatcaattctgaagactcggcagcgatggtcatccaatcgactagtggagcgacccggatttccattcgcggcgacaacatcaagatcactgcgccgtcgaatgtcaccgtagatactccgcaggcgaatttcactggaagtgtgactatcgccaacaccctggttgtaaacggcgtcaacgtgaacaaccacggccacctcgaaaacaatccgcctgatgcccggacgaaaggcggcatgattgcctaaggagaatttcatggctagttttgatttttctgatttaacagcgggggggggttgtaatggctaattatgactacatagtagatactggagtcatagtcgccgataccgctgacgttttgaaagacgttgaagcggaattcagagcggccctcggcgccaatatcaacctggcggcttcaacaccccagggaactctggtcgcggctgagaccattgcgcgttctagcgtgatgaggaatgaagctcgcattgccaacaccatcaacccaaacgtttccttcgggacgttcctggacgccatctgtgcgctgatgggaatcgagcgcggctctgatctttcgacgttcggctatggcgtccaagtgaccggccgcagccagacccgaatttccaccgggtcgcgtgtgcagactccggccggagcgattttcacggtcatgagtgacgttctgattccggcaaccggagtcgccaccatcgacgtaaaatcgcaggaatatggaaacatccctcttcccgtaggaaatctgatcatcatcgatggaaccatcggttgggccggagcgaaagtaatcgcttcaactcgcgtcgatcctggcagccgccaaatgaccgatgcagaattgaagaatgctcgcgtcaatcgtttggcgatccaaggtcgcaactcgactttggccattaaagcgtatgtcagcgccgtacccaatgttacctcggtcaacgttatcgaaaacaataccggcacggttcaagttgtcaacggcgtatcattcacccttccgtatgcggtctgggtctgcgtcgccggaaatccggataaacaggctgtcgcagatgctctgtgggcagcccacaacggcgggactccctgggactatggcgcggccaacaacggcgtcccggtggatgggcctactggcgttcctgttcgcgatccggcatccggtcgaaagtatgtcgtgaagtggactactccgatcatgtatgacggatatgtaaacgtcaccgttcagcaaggctcttcctcggtcgctccggaagcaatccagaacgcagtcgtgaattacgcccaggggaaagtggagggtgaagagggattggtcgtcggcgcgagtctgtctgcctttgaagtggctggggctatcgctcgcgagattcccggtatctacatcaaactatgccaggtggcttgcgtcccggctggatcgccggccccggctcccggcgacttctcgcctgaatacgtcatgagcgcattcggtcaggctaccatttcggttggtaacgttagggtgactttcgtatgactctgcctgcgtacaattctgatattcaacaggcgctgaagtggctccacaaccaggcccctgggatcaccggcttggttcagcgaaaggctcaatggtatgatcgtttcagccgtcagttttgggtgaactgggagcgcgacgttttcaacttgaagactgccaacccgttcggccttatggtgtggtgcatcatcctcggcacgccttcgaaaggcttcggcctgtatccaaaaaacagctcttgggcgttcggtcggctgcgccagaacttcgtttatagcgggaatcaggttccgccgcctgcagacgcatcgccgggcggcaacttctacggtggcggcaatgccgaaatcctcaacttggacgaaatcaggaaagtgcttcagctaagatatgtagcactgatttcgaacggctcgattgcatatatcaatcgcatgcttcgctacatattcaacgatgatgagccgtgggacgaggcgaccgggttgtacttctatctcatggactcaaccggcgagaatggacctgtggagaacttggccatatatcggaaagattgggaagggatggttttattgtctagctcgcccaggacgaaccatgtgctgatatcgacccctgccagtgacgctgattggcctggtgtcgatccggccgcgagcggccgtccggtaacggtcgaaacggcgtccgctacggccccggacggctccgctacggtgtgcaagcttactaagccggccgggagtaccgcctacgtctccgcgccgatagatgggccgctggggtccggtagcactgtaacgttttcgttcttcgcgaaggccggatccacccgtttcattgcaatccagtcggctgccgatttccccagtcgagccgatgccgttttcgacctggattccgggaacgtaatcagcgatcagatgctggacagcagcgtggtaagcgcccgaatgattcgtctggaaaatggctggtggcgctgcgttctcacgaccaaaaccgtcagctcttcgttccgcgctgcttacgtcgccccggcagaaaccaacttcagctggatcgattcgaattccagcacggcgattgacgtgcttatctggggcgctcagatcgaactgggtgatactccaaccggatacttggagactaccggggcgcccgtaaccatcaccgattatgttttgcagaacacccagaccggaacaatcaagttcacacagccccttccgactggagcagaagcgtattggactggagactggaaaggcgggtctgagaccgagccggccagattcgcagtaggggatgggactcaagatacattcaatctgtccagccctgcatacatcggcctacccactagtggggcgttcaagctagaatacagagttggtccggcgcttaatttgtcgccgcaattgatcaacctcatgaatgaccgggcggtcggtatcatgccgacttgcgccggttgcgatgtaaaagtcattcaggagtaatgacgtgatcacacccgaactgatacccagtccgtttgctgcgcagggcgacaaagacccgatcccgcagacttcttccactggcttcgctaaccttcgcgacggctacacgccggactacgaaatcagcctggcgtcgaacaacccgcaggccaaagcggtcgagcgaaagattcaaaaccaactcttcttcatcgcgacccagaacgcacaggcgtggcagcggcaaatggcgccgccgtggtttcagggcatgcctggcggctatgaacagaatgcagaagtcgtgcgcgtcggaaatgacggcataatgcggcgttatcgttccatggtgaatgccaatgcgagcgaccctctcagcagcacgacttgggaagagcaacccgcatggtcggtgatgcgctccaacatcccgatgccggccggaggctcaggcctatcttctggcggagaagtcatcacgaccggccgcaacttcaacgacctgttaaatgggacgtgggagttcttctctgattcagtggttgtcgcttctcagaatgcccccgtatatccggcttctgctggtgccgctgctggcatgttggaggcgaaatcttgggtgtccggggccaatacgttctgcgtccaacgctacactgatcgcgtcgggaacgtcgctgtgcgcgggcttaatgccggagcgtggaccaactggatgtatgcggtaaacgtcatggcccttcaacaaggtcgggtcacctatggagtcgcggccggatcggcgaacgcttacacgttgacgctagttccgcagctccaaggcggcctggtggacggcatgatccttcgggtcaagttcaacaccatgaacaccggcgcctccaccatcaacgtctccggactcggcgccaaggccatcgtcggcgcggccaacttccctctcaccggcggcgaacttggccaaggactcatcgctgagcttgtattcgacgcagcaggcgaccgctggagaatcctcgcaggcgcgccacgcatccaagttggcaacgccgatcaagattaccaggcccccagctggaaacaggtgaaggattacgtcgcgtcccaaaagctgactgaagtggactgggctgacgtcgtcaacaagccgaacgtcgctatccaagacaccacgccgtggttcgccaatctggagctgtccgatgctcggcctttcatcgatttccacttcaacagcaaccgcgccaaagacttcgactatcgctttatctctgaggctgatgggtcgatggcattctattctcgccaggggtctgccagtcctacccaggacatcctgttcagcaggtcgaatgtaacattcctccagccgcgactggatgttgcgaaaaacctcgcgtacatcgccaactctggtcccctttggcagaacaccactgccgatcagcctggttggaaattcaccttcgcacaaggtgtggacgccaacaacaacgcggttatcgcagtcaataccaccaacccggacggctcttatcgctcgcaggtcatgcgatgggactgggcgtccacgaacgtcatattcaacaaccgtccgctcttcgccggtcaatacaccccttgggattctgggaacttcaatccttccaccaagttgacggtgaatgccgtgaaccaaatcgccggcccaaccgggattcggaataccaacggcaacaccggcaacatgaacacctggggttccggctccacgacggcatcctatggcaatgctgccattcaaatcttcggaaaagggggcggtgagcctgccgcgatctatttcgacaactcccagaccggatggtatctgggcatggacaaggatggacagctcaagcgggccggctggtcgctcggcaacaactcttatgtcatcacagatgaattcaacatcagaaaccatatcaacacaatggctgcgcgcccgatttgggggaatgtcgagttctggggtccgtggaacttcgatccgaatcttaaactcactttgaacgctttcaatgatagctcattcaccaggatgaccaacagcggcgcgaaagacgttggtatcgcgtccatgacgagttatgctgatgcggccatgtcattcttcaactatgaagcctcgaatccgaccgggccgcgcgcggccgttatttcgttcgtgagaaatggatcgcgtggagtgctattcggcttggattctgacaacaagctgaagtggggcggatattccctaggggacgtcgcgttcgagattgccgactccaacaacctcatgagcctgtggtcatcccacgctgccgcgccgaactggaacgggcagaccatctggaggtcgggaaacttcaacccagacaccaaggcgactttggcagctcgcaatacgacgtcatcccctacaatattcagttatggggcgtccggaatcgcatcaaccggacaggtcggtgcgttggttgtggaaaacaacagcgtcaccaataccgcagccgccatcacgttccattcgccgcagaaatatcaggtcaacttcggcctggatgcggacaacgtggtaaagatcggtggcggcacaatgggcggcgtagcatatcccatcatccactccggcaactacaacaactacatcaaccaggcgctggttcaggtgggtcttggcggagtcggttcctatggaattttcgcggttctggataatgccgctccaaccgcaaccgttcaacccggagtggtcgtggacggttccattctcatctactcgtcttgcgccgcaaactacaatagcggtaaaagacctgccggaacttggcgctgcatgggatatgtagtcaaccgggatgccaacacccctgactccgcgacccttttccagcgagtgacgtaaaatgaaatggacgcggatcagaaacccacgttggctggacgcagtaaacatccacgccatggtgactttcgagggaatcggtgaagtgccgttcaccgccaatccgcaagacgtggaggcccacggaagggccatctacgctgcgattctatctggggagcacggacctatcgccccggtcgattcgaagcgggagaaggccttgcaggacgctatacgagccagggaaaagcgggctatccttcgggatacccgctggcccatagatcgccacgacgagcaaagacggctgggtatcgaaaccacggacggccctgggctgatcgcagcccttgttcactggaggcagcagattcgcgattggaatagcggggatcggccgcgacttcccatggctctgaaaacaatgttcaaaaatcaggagtattgatgaaaatcacgaagggtgttctgatcaccggaaccgggtgcaccacggatcgggcgatcaagtggctggatgatgtacaggcggccatggacaagttccacatcgagtcaccgcgagccatcgcggcctacctcgccaacatcggcgtcgagtccggcggactggtaagtctggtggagaatctcaactacagcgcccaagggttggccaacacctggccgcgccggtacgcagtagacccgcgagtccgcccgtatgtcccgaatgctctggcgaaccgcctggcccgtaacccggttgccatcgccaacaacgtgtacgcggatcgtatgggtaatggctgtgagcaggatggtgacggttggaagtatcgcgggcgcggcctgatccagctgaccgggaagtcgaactattcactgttcgccgaagactccggcatggacgttctggagaagccggagcttctggaaactccggccggcgcgtcgatgtcttcggcctggttcttctggcgcaatagctgcatccccatggcggagtcaaacaacttctccatggtcgttaaaaccatcaacggcgccgcgccgaacgatgcgaaccacggccagctccggatcaaccgctacctgaagaccatcgccgcgatcaatcaaggatcctgacattcgcccaaagaaaaggccgcttattcagcggcctttttgctttctggctttgcctcttcaaccatcttggcctcgaccggcgcggcggactcctcctgagttaccgaatccacatagttccctagtgaactcagaacgccgattaacagcgctcttactaccttgtccttgactgtctcgcctatgatcttggtcagaacggatattaactcttcccggagtctggggctgattcttggccgaaagcgcttgcgatgctctttgcgtttcatgtttagtcctctgtctgcggtcttctcctcaccccgataatggcttggggatgcgttgtgttaatcggaagggtcgggcgctattataacccgtcgaaaatgctcgcgcttaactgtttaacgatacgcaccgcgatactaaatcgccttctttctggccaaggaactctggcggcctggtccggtctaaggcctaatttgtcgacattaaaacgagaaaacccggatcgcctgtaggacaaggcgtccgggtttatttcgatctagtgtacgctagaatcagtggcttccgccccaaccgtccagccagcaatcgaagacggcgtgtctcggcttgtccttggcgccatgggagaagtgcttgaaccggatgacctggcccttgagatgctccctgtcattccagcggcgctgtttctcatcgtgggtcaggctggaggccgacacgttgaaggtgactccaggccacagacgttcgttgcggcagacgaacgcaccgaccattccggacggcgacaggttttctgcgtggctggagcgggccgtgtggccaagttcattgatgaaagcttcattgttgttgtgcatcaactcttccacgtcgatgatctcagcttcatcgtagtcgtatcgcttgactttcacacagtgcccttccttggcagtcgagcgaccgaacttgtacagtccatcagcgcgcttgcccatggaaccttcgaatcccagcattgtgtggcggcgctcgacttcgctgaactgttcgatggaagtcaccagttcctgctcgaccaggtgaatcctctcatagccgaggcagtgacgaaggaagttcacgcgctcggccgccctggctaggcgatcttcggtcggtgcgcgaggatcggtgaaatcatcgaacacatggaaagaccagtccggctcaccgctgtggcggcgaagatcgccggacgacttctggaaaactttcgggtcgctgatgtcgccgcagaccagctcgccgtccaggccgttgaacagtttatcgctgaggtattcgtagatcgattgattgttctgccgcttgagttgacgagtcagcgcctcgccttcgaatacgaagcagcgaaatccatcgatcttcggcgagaaatacatcggcagttggccttccagcagcttcgggtcaaaattcgatgcgagcatgggtttcatacagttctccagaaaagaagcccggcgaaccgggctaaatggcggtaagccggctcagatggtttcgttggcgtggttcagttcggccatgatcgacgcatagagctcatccgactccttgatgaacacgccgtcgtacatgacgcctttgcgatccttgatggtgtcgtaggcagcagcgtagcaggcgagcatggtggtgtcatgctcttccgtcacgtcgaacagagtcatggcggccgataccaggctcttgatggccaacccatgatttccacgtgccagagcgcctgccagatcgccgaggcgctgcaaatcgtcgccgtaggtgggatgtacttcgccgctctcgatgaaggccgacagatgatcgaacagattttcgccgagttgcgcggccatgatcgtggcaaccaccattacgtcgccgatgccatctttcacatcgaccgggttgttctgaacccaggcttcgcatacttctgcgaactcttcgaccaacttcaggaattgatctttcgcagacgagcctttgatcaggttacggtcggaagcccatttaaccaccaggtcgtgaagttcgcggctcatgatttgttcgatgttcattctttcgattccttttggatttgggatttgactgcgttgattatggacgccgtgctctggcgcgatccatccttggtggtgccgaagtagaaggccattaccgacttcagctcggcgaaccaatagccgatgatggtgccgatggcgaccgaggatgtcgggtccatcagagcctcgcggccgaatgtgaagattgcgatgatgatgagaatggagcctgtcagaagagcgaatgtgatcgccgggcgaacgaaatcgttctgctgcgccgcaagcctcctcgcagaatccctgtcggccgcctctgcggcgaactggctaagctcggcctggagctggttctgctcagactgaaggcgattttgttcggcttgaatcgcaagctcctggagacgaacgcgctcggcgctctggagttcggcgagacgcgctagagcttccggattcgcgtctagagcgctagcgaccgaggctgggtcggccttcgaccccagcgccgtcgcgacgatagcgccaacggcggcgcctgcaggcccacccaggagcgaccccagagccggggcagccgcgccgatcttactacctatgtctttccagtccatttcgactcctcaaaagaaaggcgccattacagcgcctttctccggccggtgatttagaactcttcggcttcggtcgcatcgccgacgccaccggcgtcactgcgaggctgttcctgcttgctgtagtccaccttcacctcgccgccgacgaacgacttgtacaggtcggccgcagccttgaagtgatccgggttcttcaccaggccttccagctcgaactggacgccggaccagctgcccttgtcgttcgacatgcctacggtggtcatacggaccaggttggcgaaagtcggcggggtgcgcaggccctgcggggtctgaacctttttctgggacagcgcggtcatgagcttcttcgaggccttgatctgcgaagacgacagggagatcagagcctggccgaaatcgccggtgtccggatcgatgacgatgacgtaatgaccacgggtgtcggcgaagtagtcagacttcttgtcgctgaccgaaccgtcttcgttcggcgcgtacaggcgtccttcgacttccttcaccttggtcgggtctttcatcatttccttgaagtcttcgacgctgatggcacccttgaaaccgccctcggcctcgcgaccggcccagcggatgaactcgcggcggtacgcggccggaatgatcagcaggccggtcttgccgtcgtaaaccttgccggtgacggtgttcaggaacatgccggccttcgcgccttcgatgtacttcgggtcatcttcatcgacctggggagacatcttctgcaaaacctggatgaaggggatggcataggactcggcatcggcgccttcgaagcctgcgccgtcatacgatcccaaatccatgaagtcgggaacttcggtagtcgcgacggcgccgccaccggtggcaactgctacggccttggtttcttcggttgcttcggaagtttcggttttcttaccagccatgttaggctccttgtttgtcgaatttcagttatcgctaactgtgggtttataataacggaagttgcaactaagtaaagcaaattacatattaagatttgctctttttcaccttcggtttcgtgatcttggcctctttgtattcgtgtacgccgatgaaatctggcagctcttcgcccttctccaggtactcgcgaccgaacgcctggagggtctggtaatggacatcgcggttgatggtggcgtcatagccggcttcgatgatggcctcggccgccttcttcgcatcttccatttcgccgcgaccgaattcggccagaaccttggtcttgatgatgccgtcgttgtcggtgtcttccagccacttccagaacttcgatttgttctcttccttgacggaaatgatggccttcggctctacttttaccgtgcgaccgtccgccagagtagtggtcttctgaccaagctcctccaacagctccggaatggtgttacgcttgagggtcttcagctcctcttccttttcggccagcgccttttgaagatcgaggatttcgccgtccagctgcgaagccttgtccaccaagttcagcagtcgatggccgatgtcggtggcttcaaccgccatttcatccatgacgccaaaatagtcgatttcgcccggcgcgttctctttcaagtattccgggatttcaagctcttgctctttcatgtccgcctccaacttagtgatgttcccttacttgaaccaagtattgagtagatattatgccgcatcttccttgatacggctactgatttacatattaaatttcgtcgcgagtgctaacgtcagcctcaaacacgccatcaacgacataacttgccaggttgcgtttccactccaagctgacctggattttctcgtcgatggaatccagacagatcaggtcgaagtacagaaccgagttgacggtgccgattcgatgatttcggtcttcggactgcatccgcagctcgttgtcttcgtcggtcgtgtagtagatggccacgtctgcggctgtgagtgtgatcccgatccctgctgcggccgggttgcccaggaacacctggacgcgcttggcctggaaatcgtcgatcaatttttcccgctcggcctctttggtctcgccgtagtaggtgccaaacgaaatcccttgggcctccaaatacgccttgatctggtcgatttcctgaatgcgcatggcccagacgatgatggaacgctccgggtcttcctccagcagaccctccagaagatcagtaaacacggcgaatcgcgggttgtcttcgggcggcaggatcaccggctcaccatagacgttgatatagccggacgccacttgcttgagcttcgagcgcgctgccgcagcatcgaaagatacatcaagcatgaaatcttcgttctggagaacaaagtggtagtcttcttccacgcgctggtaaacctttcgttgctcaggcgacatttcgaagtatatgcgcttgtacactttgtccggcaggaatgggagtgcttctttcttcgttacacggaaactgtgcggctcgatcagggaccgcagcttgtccaggttccggaataccgggcgcccacactcgtctttttcgaccagttgcggcggcatggtttgcttcccttccagcttgcgcatgatagcgatcattcgaggatcgtcactgggcaccaagacggaaaattcggccacaaacgcccgataggatttagtccccagaattccattccgcaagaattggaactgcatgaacaaatcggtcggtgcccgcgtcagaggagttccggaaaggatgcgacgggccacggccttctcgcccagctttacgatctttttcgcacgcttggcttgtgggtttttgatcctcgttgactcgtccacaattgcgcaaactttgaatgtatcaaggaatcgctcgacctcatcatagccagcctggtggttgattgcgtcaacgttgatggcgaagacgcgaagaactttttcatctgcgaacgtctcggaatacagacggtccaagcgcgccctggcctttttggaagtcggtcggccgcgccaatccacgctcaaagtcttgatcgcgacgtgggtgggaatctcgcgcagaatccagttggtgtggacgcctttgggggcgacgatgagcagcgcgtccacgcgcccctgtaggaagaggcgaacggcatcggccaaagtcgtccaagtcttcccggtgccctgctccatcaggtatgcgaagttccgtttgttcagggacgctgccagggcattgaattggtgctgcatggcctcggtcttcatgcccttgacgggatatgttttggctttcatttgttctccaaatcggcgaggaactgaacaatgttatccagtccttctgcatagctcgcaacttccaccaagtcgcggctgttaagctcgaacaaatcgagcataggattcagcagcagccaatcggttccgatcttggccaggacgaagccccggccaccccagccgatccgctcccgaagaaaagggatttgcccaggttcgaaacatctggccattgggcaggtggaagcgcgtttcggccactcctccaaagccttgaactcgacccagaactggacacctcgacgattcaggcagatcgaatcggacatgccagaccgccgcgtctccagaaagtcgatcaggattcggccgagcgagcgctgcttaaacgcattcgccgctttcgtttcgcgatcattcatcaccttcgccctctttggaaactttctctgcttgcgctgccagctttgctttttcgcgttcggtcaaaatccgcttgacggccttcacgatgaacatatcgattccgctgagcttccagcctttgatgaggaaccaagaacctgtcggcgtcccttcagcaatctgctttccgtattgcagatatttttcaggccgaattctgaaacgtatcggctgatcaaccgagtcatcaacgcacatgatgtcgagaaactgcgactggcccttgtacaccgggtttttcccttgatcggccctcttcttctggcgaatcggttcgttctcatcagacagaacttttttcaccatcttgacaatgaccagaccatcatctccatcgcggatatcccgaatgttccgaatggggtttccggaagttactccaaccagctccggattgtcataagcatgaccccagagcgtgtgagcttcgttcaaatctgcgaattgaacttcagaattcgacagactcgcggcgactttctcccaatcctgaagcgtcttcaggtgggtgcctgccagctctttatattgagccttcagccccttaagatcggccttcaactccttcagatcggccttcaacagtttctccagttctttgtcttggctgattttcgccgaaagaatctgggcttccagagctgctacatcagcagccttgtcctcaacatcctgtgccgatatcgggcaattggccagggcgatcctcgcggccttgacgtcatcacgaaggcgcaggaacttctctgccttcgccgggccaaagcctttggcgttcatgatgccgccgatcaagcgtccatccgccactacccagttaagttcggaatgctccgggtccagggccgtatattctacgccttccttggccaattcgcgaaggatggacacagtttgctggtcgtctttcgccgcccgaagacacgcggccgcgtattccaggcgatgatatcgcttcatgtagcaggtccagtacgtcaccacagcgtagctgaccgagtgggagcggttgaatccccaggcgccgaaagtcaccatttcctgccacacacggtgagcatcgtctggggcgacgcctatggtcttggcaccctcgatgaacaattcccggcgcttgttgaagaactcttcaccctttcgcgcagacatggctttcctgattgccgatgtctgctcccagtcgaactggccgatgtccttgacgatggacatgatctgttcctgatataggaaaacgccgtatgtccctgacagatattgctcgacctgcggaatggtataggtcacaggctcgcggccggccacgcgctcgatatacttggttgccataccagaagacaacggacccggacgggcgagcgccgtgatgtggtcgatgttctcgaacgcggtgatgttgatcgcgtttgctaccgagcgaacggcctgcccttcgaactggaagatgccggacattttgtcttcattgagaacgtccagaaccgccttgtcgttcaaaggcaagtcgtacaactcttgcgcggtcacgcagttcgcgtcctggatgactcccaaagttcgaagtccaagcgcgtcaattttgaggagattcagatattccgaatcgggcttgtcgagctgcgcaacgccttcggaagtcaccgtacagaagtcgatgacttcatcgttgcagaccaggatgcctgccgcgtggacgccagagtgggatgggtgaatttcgaggtcgcccatgcaggcggacgcgatctcatacttttcacggaagtcgcggccgggctgagttttttcgaaagtgtcctccaatccttttccatatcgttcgtccgctgatgtatattcgatgatcgagtttttgatgttgtcggtatcgtggaaggggatgccgaagcgctttccgacgtgagcgataaccgacgcggccttgagtgtgttgatgttacccaacttcacaacgttccaagtgccatacttctgctggagatattcgaacactagatagcgatgggtatcggcgaagtcgatatctatatcgggaagatcggaacgggaaatgtcgataaagcgctggaagagaaggcgatgcgggagcgggtcaacctcggtaatgcccaggaggtagcagaccaaagagccggctgaagagccgcgagccgggccgaccagcatatgcttcttggcgaacgcaaccagatcggcgaccaccagaaagtagctgtcgaagtctttcagctgaatctgcttgatctcttcttggaatcgatcctcatactcctgggtccattccttgatgtggccgcgactgaggcggtaggcttgcccctcgcgagccagagcgacgatatcaccatccaagtggatcatcggcgccttcgccagtttcacatccgccaactgctcgactaccgcacgagtattggcggcggcggcatcgaactcttcgcgagtcatgatgtggcgtaaacggctccacaactcctcttcggtggcgatgtggcgaaggccgaccgattcccgcaccttccaggccgacgcgaaatcagcatggtcgatggacggcatgtcgttgtaagaggtaatcaccaccggctttccgaatgctctggacgtctccatagcaccgtgcgcggcgaccatcgacgcgggattgatgtcaatgtagtcgattccggccagatccagatgggcataggcctcgccagcgaatttgatgacgccgtcagcttcctggaattcttgcggagtcaatccttgattctggaccgacttggaagtcaagcggtagaacttcttggtgtccttggcgagcacccaggctttgagcttcagctctttctcgccatcgtcggcgcatttgatcgggatttccatgccgaatccgcgaggcagttctgccttggcagcggcttgttcccaacggacgtggccccatgttccatcatcgacgatggcgacgaatggggattcgatctctttggcgcgctcgatgatctccgggaatcgaccatatgcggcgccgtaggagtaaccagagcgaacgcggagctgagggaaagacatcatgcggcctccattgcttgatatgcccgatatacgcccatgcgcttgcaaacttcgtggagcagccgcacgtcgtcgagcgcccggtgtttctgtacatatgggccgcagtagtgctcataaagatgctgcagccgcatgcggtggccgaacaacggcgccgactcttccacagtacagatatcgagcgatgggaaattgacttcgtccaggccgagcttgccgcgagccagatcgcaggtaagcatgaacttatcgaatggaaggttgtgagcaatattcgcgtcggctctggaaaagaagtcgcgaactttctgacgctgatcgaggaaagatgggtgcttgatcagatcttcgttcttcaaccctgtgatcttggtgatgatttcctcgataacgattccaggattgcagatgaactctacttcatccaaaatcttttcaccatcagttatcacgccggcgaattcgatgatcctcggctgcttcctcaaactcaccctctggtggaacgggagtcctgtggtctcagtatcccacacggcgaatatcatgtttgttccctcttatgtcgaaagggccggctgctttcgcgaccggcctgaggagtataccgcgacggctgaagatttacgccttctgtccgtctttcggcgtgatacggccggagcgcatggtggcgtggacaaacgccgaatagttgatcgagtccaaggccgaatcggcatccttgaacccgctattcgccaggcgagtgagtttgcccaccatgtgcatcacgaacagggcgagtcgatggtcatcggcggttttcgccaccaggccgttcgggaagaggatttccatgatctttccgtacatcagatcattgcgaccataggtgctctggcggtcgcggaagacttctgctgcggcgtacagattgttgagaacatcttccgcgaaatcatctggatgggaatcatcttcgcccggccagacggattccatggcgaacggcgcggcgtcttcggtcgggtcttcggactgagccgtttcagcgagcggagacggggctttcgcaaacgcctcgtcgagggtaggggcggagttcggggctgccgggaacggctcgtcgagggtaggggcggagttcggggcggccgggaacggctcgtcgagggtaggggcggagttcggggcggccgggaacggctcgcctgccatgtcgttgggcgcgctatcggggtcgctatcggccgcgacggcgaagaacggcgcatcgcaaccttccaggttcaggatgtaggagtcgatccccaggctattgtaggcatcgatgatgtcctggcgatcatcgaacgccgcgacgatcttggtgacgccttcgattttcttcagtatgtcgagcgcgactgcccgcttgaactgaggcgccggctcggtgttaccatacggccgcatgatgagttcatactcgcgatgttcggcgatgccgagttcgcggtggagcttggccctggtctggaaaaagtggttgtcggttcggccggtgacgaagaaaatcatgaggtcggcgtcgatggcattcctgatgcgacctacagcgtgcgggttgagagtgtccttgtcgagacgagaatgatactcgtcccattgccgttccaaggcgaagctcttgcggtggctatcgtcgaatacgcagccgtccaggtcgaagatgatgatgccattctttggtttgcgttccatattcagatttccttactggttgctttctgggtgacggttttatcgatgaacgtcccatcagaagtgaggcggaaaacttcgccattctggatgaaatcgaacgattgcacgttcatcgtgatgcgaatggattcgctgccgttggtcacttcgacttgtgcgatgtcgccaactttctcgacaatgatcttcatgttacatggacttcccattgacggccacagggttggcctcttgtttttccgatccccagaaatcgcggcgcagttcttcctgctcggccgagcgatccatccaggggcgatagaacttgcactggtagataggttccaacggaacatcaatcacaggaatctgacctggctttgtctccagagcggccatgaaccggtcataggatttctgctggatttcctcttcattcatcaccttcgacccatagcgcgggaaggcgcaggagccggtggcgacgcagtgcggctggagcaggctgtcgaacataggatagacttccagaaccagccggcgcatttcgcggaatacttcctgatattcaccctgggtccgaacgcacaggcgaaccttcgccatgtcgctgagagtccgcagattgaacttggccgcgatcttcgtttccatgttggaagggatgatggcacgagcgtcctggagcgacgcgccggcctccagaagcttctggtagctggtttgcgcgtcggcaatggcgtcatgccacagacggttcagctcttcgcggacatggtaggtcgggtcaggctcgccatttaccgtagccggttcgtcgaattcccagcggaaggcttccggctgaacgacggcgctgatttccagagcgcgactggtttcctgctggtaagccccggtacgggtccgaacgagttgatgggtgaagttcttgctgacaccctcgatctggaaaatgaagtccacgaactcgaacggcgagcggatggtgtccagcatgtacttccagtggtcaagcttttcggcctcggtcatggtcgccgggtcttggccgcgcatgcgagtggatttcgtccccaggagaagttcccaggcgttctgggtgtaactgatcagagaaattttcatcagaaatcttccggaattggcgtgaagtggaattttttggttagagccagggccaggccttgggcttgctctttacgaaggccatactgctctatctcttccttgagcagttcgcaggcctccagacgcgactcatactcttcagcctcctgaacggatgagaaaacggttccatcagaggttctgtacacaagttcaatcgacatgatgacctcagtagcagcggatgatttcggcgcggatatctcgacggtcgaggtagtgctcacgaatcttatcgcgggcgcgctcggcctcttctcgactgccgaacgacaggttgaacgaagtgaaaggcttatcgtccaggcgcccatcgccaatcaggtacaggatgcctaccagcacgaaagacggcgctgtctgtcgcgtttgcggcgggtcgatttgcatttcgaggaaagacatgggaacctcttcaggatgatctggtgcgtacattaatagcgctcctgctgagcagctacggtttccggctcatagatgagcatgtcaacgatttccgggcactggcctttcacccagtcgatggccgcgaccagtgtggtggaagcggagaaagagaaagtgcggtaagactcatggatgtacggcgaccccatcgaatcgcgctcggtcgtgcgagaaatgactgctttgatattaacgatccggcccatcttcggcctccactttagcgattatatctgacaggctcagcttctcgccattcaggaaataactggcgcgaaacttcctgtcaccctctggcccgacgatccgggccgttatggtgagactcccgccgccaagggcatcggtgtccctgaagaaagccagcagcgcccgcttgagcgctgcctcgcgaggatcgacggccattaacctaccacgttccagccgtgctgagcgcaccaaaccgcaccggcccctgcaggaaggctattcagaaggaacacaggagtcaggcgaccgtcctcggtcatatgtatgaagtagcgggcgccttcaccgagccattcggccttggcgatagcgcgttcgagattggccttggtggcgtaggttttggtgtggttcttgtcggtggagaaggttacttcgcgggccatttgtcgattccttttggctgaagggtttcgcgtttcgatgagggaatattacgcccacctgatccagaagtaaagcacttttgtaaattacttcacgaacatctgcttggccttctgataagacgaagaagtcatcaggcgctcgatgacgtccatgtccgaaaccagatcatccagaaggacattgcgccaggtagcgaaccggccgagcgagaagatgccagcctcatgggtgagattccagatcatggattcgcgctcgtcgcggccgagaggaacgattttgcctttggtctggatggtcggctcgccgtcctcgattagctgtttccttctgatcccgaaggccgcgcagacttcatccaggtcccatgccggattccattcgatggtttcgatctcaccatcagcattctccaaaacgccattcgcgacggattccacgatcagagtatcgccggtgatggacgcgcgaaatgtcccgaagtcgggactggggaaataaacggtctggaagacgtcacaagggatggaaagcttgtatcgactcacgatgatggatgtgcctttaccgaatgacgggtcgatacccaggtccatccccgccgcagccaggttggcgcggaacggcgcggtgcttatgacattcacatggtcatcttgccggcgaaggtactggaagaaagaggcgtcgaaaggacgactccaagtgatgcggttcgccagcttggcgacaagctgctcatagaagtcggccggtgcgatccaacgcttttcagtcgccagattccagatggaccggtccgacaggccgcccgttactttcctggagtacatgttgcagtggtcgatgcgcggctgggaaatgaattcgccgtcgatgtagatagctttgtgtacagtgacttcgcggaacgggataccggtgagttggccaattactggcgagcggaatcgcaagagtgcgttgtgacgctccttgttctccggcgtcgccgcgtcgatgatttgggcttgagggaaacgatgcgcggcgatcaggccggcgagtccagcacctacgatgatgactttctgatcaggaatcatgatgtgttccttctgagtgtacaaaacttgagaggataaaaaagggacccattttcatgagtcccttgaagagctagacgattcagtctcagaagagcggcggcttactcttcttcaccatcggaaccgtcggcgccctgatcttcaccgtcgtgctcctggccttcatcaccggccttctcgtcatcgccctggccagcttcgtcttccttcgaagcgatggcaaccagatcgacccagcccatgacttccagcttgctcagatagctgcgaaccgaggctccatacagcaggtgtgccactttctcgccaaaagcttcgatttctaccggctcaccgacggcgcagttctcgttgatgtaggcaaacaccttgccgcgaatcgaaatggcctgcggggtgccatggccgtcgccggtcgggatgaagtgggtggcgcgagggcgacgcgagccgttggacttcagttcctcgcgacgggcttcggccttcgcacggcgctcttcctgctcttccttgcggcgctgcttctcggcttcgcgctcggccttcttctgctcggccaggcgcttgcgctcttcttcacgagcgactttctgggcttcctgcgcggccttcttctcttcggccttcttggcgcgctcggcttccttctcggccttcttctgctcgcgctcggcttccttcgccttcgccttctcggcctgctcagcttccttcgccttggccttttcagcgcgctcggcttccttggcggcggccttttccttcgccttctcggcgcgctcggcttctttcttctcgcgctcggctttgcgcttctcttcgcgctcggctttcttctgctcggcttccttggccttggcttcggccttctcggcgcgctcgcgctctttacgttggcgctcagcggccttctcggccttgcgcagggcagcggcttgttccttggtcagctcttcgccttgggtctgttcgttctggtccatgttcttactccgggaatgtttgaaaggatggcttattggcctgtgagaggattatctctaaactaattgaagaagggaatacctttcgcctgaacttctctaaatatttttctttcgggaaagtccagactccagggaacttatttatgttagcgaagtttttaactcttacgcaaaaacaacaagtattcgattgcgcgagttatcccagtatacatcaactgactataagggatggacggcaagttttcttctaacatggcaacccgtttccattctgaaccctgcgacttgtggaacgtcatcgcccagccgaagtcgaatccgccaatagccttctgcgcctccagccgcacgtcttcctcgaccgaaaagctcagagggttgaacttcacccatcgttcatagttcgtgccgataatgcgaactttggcgaacaacatttcatcaggctcgtcgtcatcttcttgcccttcaggaactggcttgaagtccagcagaatggcttgttcgccgttcatgattccatattcgtgctggttcccagtgcacaccagcttctcaccgattcctggctgcacgcctttgtagccgaggattcggcgagcgcgtgcgttcaagcgacggcgagtattgttgtaagcgcaaagaatcacaccatcgttgtccaggaacgtccgcatttcatcatccgacatatcgaagccggcccggaccactatgtcatcatactcgcggcagggcaggcgctttccctggcggacgaacatcgacgcccgaacgatattgccggcgttgcgctcgatttcggtcatgatggtatcacaactgttctcgtggaagatctggacgccgcgcacaggaggcacctggccaaagtcgccgatttccaggaccggaattcggtgcgacaggaggcgctcttcatcccactcgccgatcatggacgactcgtcgagcacgaccaacttcggcttctcgtcgagcgagtctttgttggcaaacatgatttcgccgtcttcatcttcgccaatcggccgatagatgaagctgtggagggtccgggcattggtgcagcccttctcgcgaagccgcgctgctgctttcccggttggcgcgacgaagaccgtccagtccatcgagcagcaaagttcggcgatgatcttcgcgatggaagtcttaccagttccggcgaaaccagcgagtcgatagacctggcggcggtgcgctcgatcacaccaaccgcgataccagtccacaacggaattgatcgcgtcgatctgctgactgtttggtcgaaagccgaatcgctcttcgatctgatcgacggtgaagttagatgctgacatatttgcgttctccaacgctaggtttaattgaatcgaggctcagtttaagcacgccgtccacagaccagccagtatcacgacgatacttgcggccttgcgggtcgacatagaagttcttcgtgcgccgcagcagaacataatgccaagcagctccaagcgcgtggacccttcctttatacgggaaagccttcgcctgctctgcggcctctttggccccagggagccagcggacggtagaaaggaccaggaccgcacccttaatagcctgggaagcggcgcggccgtcctgtgggctatagcgatgtctatcgaagtctacccagtggtggttgccgcgccggagcttgaccgttcgggatcgcccctcgaacaccacagtgccttcgtgagttaaaatatgttccgccatcgaatgttcctttataacgtacagttatgctttacctctgcgcaggaagagtatactatcagctgactcgccaaagcgagcgaatttaatccaactttacttcggcaggaaagtggccgatactagagccgccgcctgtactgccctccaaaacagaggatacattaaatgcaagaatgcaagatttcccgcgaccaactcccggtcggtaatccgaatcccaatgtcgacaagacccgcgacccgaaccttaagcccggtttcctgcgtcgcagccgcgagctggacccggcgctggccgttcgcatccgtcgcgagctgatccacgccgaagcatccgacttggccaaggccggatgggtcaattcacagtccagcctttatggatcgaaagccttcccgcgccattccgtcgttcgcgtgaccggagttccggaagatggagctttcatcggcatgctgatcggcttcatcgagcatcgcgagcatggcgaatgggcggtcatggaagccggaacgaaagaaggcggcgccgtcattattccagtcgatcacatcatgcgagcgtcattcgccgaagccgaagagttcgccgaaaagtgggagcggaacttggggtggcgtctcctgcgccaactccgcgagtgcggcgccctggccgggactgaagacgagttcctgcggcggatcatcaatcgatacgttcgtgatcgcacgatcctcgatcaccacaaagtcggcgcggacaaaacctatactgatgcagtactcaaaagcatcggcgaaacatggccgaagattccttcggggaaattcgtcggacaccgagtcgcgcagctcctgatcggccacaagctaggtcgagcggggaccatcctgaatgacctggtggacttcctggagaagttcgcggccgggcgcgataaaattctcaacatcgccatctgtaattgaggtgaatgaaatggttgacttggaaaagctgagtccaaagctgagtcctcggcagcatgccgttctactggagatgtacaggcatcctgagcatccagttcacagatcgccaacgaatttaactcttaaggctttgagacgaagggggcttgtcgagctatcctggaaggattccgtggctggatatatgttcggtcgccaaccttgctggaaaataactgatgccggcataaggcgaatcctgggagtgctggggaataatatggaaaaagaacaaagcgaagatcgcccaagcatccctgagtttgagaagaccgacgccaacaaactctatgatgctctggagacgatttcgctgctggagaagaagttggacgaatccgaaaagcgcgggagcgagctggccgcgagctattgtgacggcgtagtcggcgatgaatacggccatccttattgtcgttataaagtggaacgcgacgccgccttggccgaagtagagcgcctgcgagaatcaaaaggcgatccctctggcagcttcgacaggtgtatgaagatgatgtacgagcgcgacgagaatgcaaaacgactcgacgccgccttggccagggtcgcggagctggaagggaagttgacggactgggtgcacgaagggttccggctcaacgaggcgctagcggtcgccaaggctcaacccagcgtgccggaaatatctggcatcggtcgcgatgccgaacatcccagagctgtagtgctgtatctgcgtaacgaacccagcgatgaagatatgcgagcaattcagaactttttgcgcgccatggccgcccccgctcagcacagcgtgccgaaagcatggctcgacgttcaggcagagcgccgccggcaggtcgaggcccaggcgctaaggcaggaagtcgcagcactgcgcgcaagggcggatgttgtgccggaggtgttcgggcttgagcggtaccgcgtagaaaaaactgggaagggtttctggccatactgcgtgcgtgcgggggatggaacgcgtgaactgttcgtcggccacttgaagcagtgtcagcgggtagcgaccgaattggctacggcgtttgaagatgggaagtttatcgccgcgcccggcagctcggctcagcacagcgtgccggaggggtggaagctcgtaccgatggacccgacatcgcagatgacctatgtcggtcagtccctgcgttatgacgcggtaaacagcatcggcgagatttaccggcaaatgctcgccgtagctccctcacccatcgatccggccgcgcatcctcagccgtgccagcaaccacaggcccatcctgcccgctgcgggtgcgagcggtaagtgccaagtaaggaattcatgtaatggaacagaagaaaccttcaccagtagatggagtcatcatgaccagcctcgacgttctccggaaagcacagcccgaagcccaggacgagtatgccgtgtccatgttcgcaacggcgatccgccagaaaatgcagcgctcccgcgataaaggccgaggcggctggatcgactgcgacgaagatattctgatcaacggattcgccgaacatgcgctgaagggaaatgagaacaacctcttggacctggcgacgttcctgatgttcatgtgggtgcgcggcatcgacgatgcgaagattcccccggcgctcgaaaaggcgcgacagcacaagatcatggaagcctggagtcgaatccatgaagatggcctaaactccgccagaaaggcgagtgctgcgcgacaattcgtggaagtgcctcgacgcaaggggcgcccggagcgacttgcatgaagcctcacgaaataagactggcacaggccgaagagttcctgcgcgaactcggccgagggattccagacgacgaacgggtgatggtcggctacgctgaagaggccacagtccaaaccgacgagaacggccgcaagctcaacgccggctggtggcctgtgccctggaaggaagggaaatacataaactcccgatccaacgcctacgcttgcatctcgtcatccatcaagacgcccaacccgaagaccggccagatgcgatactggcgcggcgaagcctctttcggccacggcctggcgttgatggtcgatgacatcggctcaggcaaagggtccaagggcgacttcgaccgcgacgagttccgcgagcgactagagccgaccgcgattgtagagacttcgccgaacaactaccagttctggtatttcttcaaagagccgatgtcacacatgctccagttcaaggcgctgctctattcgttcgtggaccaggtgctaaagaaaggcggcgacaacaccgtcaaggacgtcagccgttacggccggatgccattcggcttcaacaacaagcgcgggaaagacggcaagttcaaatatgccgacgaaaacggcaaacccgaactcgtgcgcctgtacagcgccgactattccaagcgctactcgccagaggaaatcgcgcaggccttcggcgtccgcatcattatgccacagatgaagaaggtggagataaaccgcgacgattgggtgtatgaccaagtatggctgaagtatgccgagcacatctgcacgaaatacaagatgggagaagcggcaggcggccaggtccagcagaatatgtccggcaaataccgcatccgctgtccctggggcgacgagcacaccaacggcgatcctttcggcgcatactttcgcggaccgatacctggcgccgagcacgaatatgtgttcggatgcgggcacgatacttgccgcaaagagcatcgacggacatgggcggccttcactgatgaagtcgtcctgccgtatattgtcgaacaacttgaacgcatcaaccgccgtcacatcggcgaggagtagtaactatgcaaaatgatcctggaattctgattaccgccatcggctcattgcttctcggccttctcgtcttcttcgaaggcctgaatggatggaaaataccagcgtcaaactttctcgcgtcgctcctgtgcttcttcgtcggcctttctgctttaacctgctggttcgtcttggcgtttgacgtgttttagtcgacgaacggtccggaaatttcggatagggacggaacttattagctctgccggtttaggtaggagataatagccgtccctttcgcctcaatatgtagaggcggtgttatatccgatcatgtaaagcagaaggcggcaaacctaacatgattatcgacgacgacaacattcttggtgatgataatattcttggtgatgacgaatcggggtccagtgagttcgatctcacacagatagaagatgctggaatggaccctttgatgaccgccgcaagtaaggcggccgatgatgcgattgcgaggaacgaggcgcaccgcgcgcaaaaggcggcaagatacgccgaggcgtatgctgaaccagacttgaggaagcgagcgcggttgttgatgctcgaccaggcctttgatcttccggtcagccggctggtgaaaggaccgttcgatgactttatcaccaagtacagctcgacttcagacagcaactacctcgcggtctatgatacgttgttctgtaagggcgacggaaccgtcccccacccgcacttcgacgagtttcgcggccggctggttgaccaccgaggcgtggcgttcaataacaagaccctcgaccccattgacctgatgggcgccctcgcggctgcggccttggacgatccatcgatcaagaagacgattgaaacttgctgcgtgtgggcgcgtcgatatcgccgcaactctttgatcgaaacgtttgagaagaagataccggagtgggatggtgaagagcggatcgacacgctgctgatcgacttgttcaaaccgttcgacaccgagcttaaccggatggtgagtaagtatttctggctgagcttgtactgccgcatcaactaccctggaatctcagcgccgatttcgctggcgttgattggtgggcaggatgctgggaagacttacttttcaatcttgatctgtaaagagttgtcgagcgaccgaaagttatcgccggtccagcttgacctgagccgtcatgaccagacgccatttttgcgcaatatcactggcaactcggtgatcgcgaacgtcggcgaaatgtccggcttcaaaaagggcgacatggaacgcattaaagagttcctggtgcgatccgatgatactttcgatcagaagtttgaaccaggcgaaactatcagtcgacaatggatcaccatcatggacggcaacggctatgatggtcttcaacgggatgagtcaggaaaccgtcgattttatccaatgttcgtggcgcaacttcccgacgaggatggcaagccgaattgggttaaaccgggcgatggaaatgaaactttccgcgttgacttcacagacttcggccgcaaattctggcaagccatggctgagtgccgcgcctggattaaggcgaatggcgtggagggatatctcagtctagttcgggcgaccaacaacgaagtccagaaattctctatttcggaaatggagaatgcgcgtggcgtggttcgtgatgacacgattgatatgtatctgatcaacgtgctgatcagttgcgagttcgaagagatcaagcctggcaggaattcaaagaatcctggatggagagtcaacaccatcgaaatcctgaaatggttcgatattctcgccaggaagaagccgatttctcgccacttaactccgcacctgaaggcgctaggatttgttccgaataagaatggcttgaatggctggtgcctgcctgtagataaggttgcgcctggatggaccagagatatgcacacgacgttgccgccgttcaatgatgtgcttgtatacttgctgaggaaggttgattctgaggtgactgatgaagaggcaatgattcaaatccgcaaagttaaggccgagcgcgcaaggatattgggtgaggatttctgatgtagtgatggagtgtacttggactaggccgccttcgggcggtcttttctttggtgcggagtacattcgatttcggttgtggccgagtgagattcggaagctatctggtaattagggtttggtggcgatggcgcgttgtggaaagttcgtgaacgttggatcaaggattttgtgcggtgattggatgaattgtggaaaatcgacgattctgactggatttttggggtcggccgcgccggtcttactggtaattaccgaaaccgggaatttgggtcgagccttagtgccgcgtgggcttgaagcgcttattcggatacttcccggtttcggatgcagccgcaaaagtatactacagcgaaaatcga

SEQ ID NO: 2 - DNA, 66657 bp, Myoviridae Pbunavirus
  misc_feature (1)..(66657)
cgattgcacaatcctaatagaaaaaatctatcacggacgttacctatctttaaaattaataaaattaatagtaatttggtaatttggtaaactttagtatttgaaagcctcgcggcactaagcttgtacatatcccgtcaagtttccgattccagctagctcgcggcagggtcgccggaaacttccggacttccaatccatgggtcgcggcgacaccacggcggactaagcggcaaggaccaaaactcgacgaacggaaccggaaatttgggagcgcgatagaatcgctcagctggacatatttctaacattcgatttaacactcaatccaaacactcaccaccagcgtctcccgccaaccgccgattcgatcctcacccaccagcggatcgcccgtataacatcctataacaccacctaacactcattcatcatcaaacccacccagacctacagcccacccacaagcagcccatagacgcgatccctggccccatagtacaatcgcgccatactcagtgtcgcggcagagcaccaggggccatccgccaaccaagccaccacgacgactccagaatcgaactccagggacgcagcaccaaatgaccaaacactacagccccgacgatctagtcacgccacaggaattcgcagacccgcatttcgcggcgatcaaccaaaagcgattcgacctgtacatcgacctgcgcgtccaaggttacagctcctggcgggtcttccgggccatctggggcgaggagcatatggacggtcccgcgcaggcccgcatcttcgcgatggagtccaacccgtactatcgcaagcagttcaaggccaagttgaacgcgaccaaaacgtccgacttgtggaacccaaagacggcgctccacgaactcctccaaatggttcgtgaccccaccgtcaaggactccagccgtctgtcggccatcaaggagttgaacgttctggctgaaatcacgttcgtggacgagtctggcaagaccaggatcggtcgcggtttggccgacttctacgcatcagaagccgaggctcagaccgcgaccgtcgctgctgcggccgaagccaatggctatgtgccggaaggcgaagagggcgatttcccgtccccgacgccggaaccgaccgaggaagaccgcgccaaccccatttagacataaaataacatcgttctaggcccgaatcggaccgaactaaggcgaaggtagcggtaagggacgaaaaacgattctagggcggttctaggaagttgaagcctaaccctcagaacgacaaagccccggactctagttcagaatccggggctttctttttgggcgccttactcgccagcttcgatgatttcgaagttgtatttgacgccttcgtgctcgaaagtcatcttgccagccgccttcagctgcatgcggaagcggatgtgtttcgaagaaggcaggccgaactcgatgaatgctgcgttggtggaccggaactcgccgcgcttgccttttacagtcacagccacgccatggcgctgggtgcgtttcttggaaacttctgggtctttccaggagttggcgatggctgccgacaaatccttggcctctttggctttctccggcgcgttcttggcctcttcgcgcatcttccggatttcttccagcgcttcctcttcggtgacttcttcttccggcttcagattctcttcctcggccttctcttcttccttcttcttggaagtgcgggtcttgtaaaccttggccggggcttcctcttcctggaaggcctcttcctcggccggcagagcattcaggatggcgaggcagcgacgctcagcagtcttgcggtcagagaagcgcttgacagtcgcatcagcgttgtgagcgttgtagaaagcgaccagttctttcatttctgcgttctggatgtcgccgaaggttttgatggagttggtcatcttgcgatcctctgttttggaagatttcttttgggcttcggtttgtcgcccccgttgaaagagattatgcctaggtcgatgctgcgtgtctacatctatttcatcagattgatcacaaagccgacgaacggttgtcggatgtgaaaacaccgcagagcaggctgcggtgtttgttggtgagggcgatggtcagaaagtcgggatcgtgatcggctcgatgggcggatcgccgggcctgtcgttgtccgatgcgggcgccgggttggacgggattgcgccggaccgaagctccagagattccgactgcctgctcacctgcggagctggaggcgcctttggcgcaggaggagcaggcgggaccggcaggcctggaggcgccatctgcgtcatgggcggttccggaagatcgggaaggcttggcgctatgctgccaaaggaccgctgcgactgctgtgccggattttcgccgaacatttcggcggatcggttgtccttgatgacttgacctatggccgtcttgtcggcgcccggttctgccggatcgaagccagtgaatggagtggttgtgcagcgcatgttcggatgggtcggcagattgttcagggcgatggagtccgcccagacgtacgggtttttatgcttgccagggctgtggctgatgatctcggcaggaatgtgaccgttcctgttcagccatctcgccatctcctgccgattcagagggctggccacgatctggccagtggaatcttcgacgatagcgaacagatcaccgagtttgaatccgatgattgtgtagttggacctggactcgccgacgaaagccagggtttcgatgttgtggtagatatcttggtcttcccagatgtacagcatggttcactcctcaataaggctgcttgttgtgttcgaccagagacataccggccggaactttgaagcggatgtattcgatcatcatcgcggttcggcgtttgttggcgccggattcgtcgttgacgaagagttcgcattggtgcggaatgactcgcgtcaccaggtcttcgcctttcgaaccgtagaacttgatgtaggctgcgacgcctcgcgtcatgctcagatggatcgtttcgcagagtcgctgcgcggccgacgcgctggacagatcggtcggactgaccgtcgcccagtaatggccactttgttctttatcgggcataagctaccctccaatgagaaagcctctgccgaggctggttgttagtcgagccagtcagtcgtacttcctgccgtgaaatgcgtgtccgcagccgaagattgatctgtatgcgttgattgaattcctgttcctttcagattcgatttgaatactgagcatctccagctcgtatcgggccagtccgccccattcgcgctcaatgcgtgaatactcggcctccagttgcctcaatcgttcgctcatataacctccaacaatcgtcattaatcgatcaacccctgccgaaccgcagaggctggttgttaatcgcgcttcagcaaaaccactttctcgtttgcgcgatgattcctgtgccagtcttcccaatagtctccgcactgacgggccaactccagagtgacatagccgtcgtcgctgctacattcgacagaaaggacaatcgcgttgcctctggactcgctgccagacccgaatccgatcagaacttcgtcgccagttttcagctcatctgccctgattactttggccatggcgttctcctattgggtagcgccgcgagggcggatcgggtcgatgtcatgtaagcagatggtgggatagtccctggccagcttgagcttgaagtccacccagtcagcaccgatgagcgccgcgacttcgatgcttactttgcggtgcggcgcagctccagatcgcaggactatagcccgacgccgaacgggatcgttgacgtcaacatgcgtgagtatttcgtcgccgacgagcaactcgcaagccatcaatattttggccataatacactcctatgaggaggcgcgcccaggacgatcccagccgcgccgatggattaacgtttgtgaaggatggacactgcgtccacgtcgaggatgctgatggtacggcgacggcgcggattgctgcgttcatggatgcgaatcaggtcagcggatggcgcttcgtgcaccacccatacatcctccggcttctgcgtccggagcaggaccgtcacttctgtgttctgggcgaggccgttgcagatgaacgtgaacttggacgagggagttctgtacatttcgagattcctttttggacttcgggtccggctcctcagccggtgaagagattatgcctgatcatcgcagtcgagtaaagcacttgtgtaccaattctccagttaaatggaaccaaagcgcggtatcgctgattgctacgctcccacgccatggcccttcttgctcacagacttcgaaccacaagctgatttccattctggccaggactcggccgaaggattcgagccggcaccggctggacagaatgtcgacattcacccgtcgattgatttcgtaccggcgaccgttgatgacgaataccaagcgtagagtttgtccgtccagacattcccagtatctggtttcataccgaagccaatagcgcttgctagcagggcctaccatagtcatttaatcgatgctcctggccgcgccacgcggtccggtcggcgggacgggatcgaaccgacccaggatgtagtcgggccggcgcgcttcctgaggacacacggcgagaaggcgccatcctgcgtccagggcatgctggagttcgtccgtgcagcagtcttccttgagcagcagacgattgatgctctggagatttggaccagggatagcagagccggtgaccgagttccagccttcgataccgtgcaccatctgcggctggttgatgtagccttctgacctgccagccaaccggctcgcggccagctccaggcgctccagcattggccgcagagcggcttccgggtcaacatcgtcccagagcaggaccaggttgatgatggtgtacggatagtccttgtccagatcccaggccgaagcggtcagacggcccaggccgatttcattacacatcacgggaacgtcgttgctccaggtggacggctcccagttccgctcgccaggattcccgattgttacgccttccaggttccccaggagaacgtggagcttgctgacatattccgcctccaaggctttccgctcttcgtcggtctggttgtggcgatagaaggatggagggctgacttttgcatggtagagtttcataactgttcctcggttttggaaggcttgaacgttagagaattgtgtcgcagtatttctcgaaaggactctggcgcttcttctcgcagatcgcacaggtgatttccaggtcgggcagctcgctgtaagtcttgccgaggtacagccagcgcttgcacaggctgcgaccgtccgacgtgaagaaatggactttgcgagcgtcgccgggttgcgcccagccgccctgatagttttcgcgcttgctcatggcgatatttccttttggatcgtggatccatggtgtacgttcagtcacccaaactccatctacatagatcaggactgacagagcagtcgcgccaaacccgaagcctacatagaatgaacctggatcgatttccatggtggcgctattagtggcgctattgcaatcgacttcaaagtcgaatagcgaatgaccaatcataccatcaccatgtcgatttcattgacgaagaaatggacatcgacaccatcggcgctgccggtgtaacgcagccgagtcgtcccatcaatgtgggcctcctcgacgccgacgacttccaggatggtgtcgttgcagtacagtttgacgaacatcttgatgccagagccaatcgcctcgaaggcgatctgcttgtacaggtcttgcttgatcatgctttacgctcctgtttgcggatgtattctgccctggcttcggcttcgagcttcgcccaaagcgcgttgtcgactggaccccagggacctgtctgagttccgtccaccggtgcgaacttgccaccggcgcgacgatacttggacagagttctcagaccgatgattttctcttcttgggaatcgagttggacgatcacttaacatacttcccgaagtagcaggtgtggaggatttccaggcccttggaaatggccttcagcttgataccgaaattcttgatcgcccagtccagatcgtggtgatagaactcgatgatgttgacgatttgaccggcgctgtagtggatgacgcgaaccttgccattccagcggaaatcttcgcggctgtttacggcctcgacttcgatagtgtcatttctgccgatggtccatttggagctagtcatgtcgcaatcctctttttggagcgtttcgcgtttcgatgaggtaactatacttcagtcacctcatcgagtaaagcccttttgaacagattgcctaaaatttctggaagacaaaatcaatcggtcgcgtcatcgatagcgaacgccgagcgcgccaggtcgatgatctctggccaggtcaaagtgaaggttttgccgtcatcgagaatgatgatgggagtccgcagcggctcgccaaccagcagttcgtaggaatgtttctcgctggatgcggagccgatgcgggtgtggagggtgagttaggccggggaaatctcggccgccgtaaaggccgcaatgcgaccgctattcagcctgacgaacaccgggaatgcgccgccctcgcgaatctcgctgatcacgccgtggccgccgccttgcgcatagacattctgtccaacagacaattttttgaggatgtcgctaaaaactacggttttcatcgtcttgccctcggtgatgcccggcgaaccgggcggggtttgctacagcatgcctgctttgcgttcggccttgatggtgtataccgcctcatcgaccagccactcttcagcttccaggtaggctttggcgacttctacggttacgttggcgaatttggctacgttctggattttggcttgcttggtcatttcgatttccttttgtctgaagggtttcgcgtttcgatgaggtaactatacctcagtcacctcatcgagtaaagcattttcttcagattatctgaaaccttttgaagccaggaattgccgccagagccagtcgatgtgttcgttgcagtaacgctcgccatcggacgacatagctaaggcgccatcattgatgccgaagtgggccgcagcgagacattcgaactcgaactggagcgttcctgggcgagggatatgggacatggcgtatttctgcacggtcagtgatcctcagaaggtttcgcgtttgcgatagccgctactttctgcataccgaggcgatagaattcggcctcttccctggccttggccagattatccctggcttcgcacgccagcttgtactgattgttggcattctggatgcttccgtccagactcctgtccagttcttcccgaagagccttctgcgacgctagctcggcctccaaatcctggattctgatctgaagctggcgattcctttcagacatctcgttttcgcgggcgatggagttctgaaggcattcgtcaaggcgagtattttcgcgcaccagctgatgcttttcgactttcgcctttctgcacgtctctcgcattgctgaaagctcactcgcatgcagatcgtcatccgggtctttacgctcttccttcgactccatccgcatatagtactggccggctgcgaaggcgagcactgcctggtcggcatacgctgcggcatcggtcatgtatctggatttgtagcgaggcagaaacttgcactcctctggatcccagaggagactatcggcaataggccagaatttgcggaagccatcaggatcgacttctacattgaccatttgcagctggccggcctccacttcgacttccagaggaacctgaatggtgccggtgatgtactggaagtacactatgctagacataacacaatcctcataagaagttgcggccaggaccatcccagccgcatcgtaatcactcttcgccttcgtccgcgctcagccactcttcgaaggcgaaatttaccttcgactcgacccaatcctgcagctcatcggcgaactcgtcactgtcgatgtccatggtgattcccataacttccatgttccatagcgcggcattcagttcgaactgtaccatctgctcgccatcgacttccaacaggatgcggtctgcgacttcatagtcgtctacatcgaacagatggccgcccgccaggaggtgctggacgaaagcttcatcgaggttggtgacttcgatctggacttgtttggtcattttcgtatccttacttagcggctttgaattgggctttgaggttggcaagttcagctttcagatcgatcatcgcctgaccgcgcaggccttccatttcagcctcgctgattgcgatcttggctgcgcggattttgtcgttgatttgatctttagtcatttcggcttccttttgtttgaagggtttcgcgtttcgatgaggagattatgccgatagtcagaatggaagtaaagtgtctgagtgaagaaatttctgtacaccgacgaacggtcgcgctcgactgtctgctgcggtgtcgatatactcggcctattgcgaacgatggactgattaaatgttcaagctcaatcctgcactgcgagcggtctggcgaactcgtgcccgttacaaagtcatctatggcggccgggcgtcttcgaagtcgcacgacgctggcggtatagccgttttcctcgcggccaactacaagctcaaattcctctgtgctcgccagttccagaaccgcatcagcgaatctgtctacacattgatcaaagacaagatcgaaaactcagagtataatggcgaattcatcttcaccaagaactccatcaagcacaagattaccggctcagagttcctgttttatgggatcgcccgtaacctgtcggaaatcaagtccaccgaaggcatcgacattctctggcttgaggaagctcactacctgacccaggagcaatgggaagttatcgagcctaccatccggaaagaaaactctgaaatctggatcatcttcaaccctaacgaagtcaccgatttcgtgtatcagaacttcgtggtcaaacccccgaaagactcctgcgtcaagatgatcaactggaacgaaaatccgttcctcagtgagacgatgctcaaagtgattcacgaagcctatgagcgcgaccgggagcaggccgagcacatttatggcgggattccgaagacgggaggcgacaaatccgtcatcaacctcaagttcattctcgcggccatcgacgctcacaagaaactcggctgggagccggccggatcgaagcgcatcggcttcgacgttgcggacgacggcgaggatgcgaacgcaactacgctcatgcacggcaacgtcatcatggaagtggacgaatgggacggcctggaagatgaactgctcaagtcgtccagccgcgtttacaacctggcgaagatgaaaggcgcctcggtcacttatgactccatcggcgtcggtgctcacgtcggttcgaagttcgccgaattgaacgatgccagcccagacttcaaactgatctatgatccattcaacgcgggcggcgctgtcgataagcctgatgacgtctacatgaagctgccgcacacgacgatcaagaacaaagaccacttcagcaacattaaggcgcagaagtgggaagaagtcgcgacccgattccggaagacttatgaagcggttgagcatggaaaggttcatccattcgacgaattgatttcgatcaactctgaaacgattcacccggacaaactgaatcagctgtgcatcgaactttcgtcgccgcgcaaagacctggacatgaacggccggttcaaagtcgagtccaagaaggatatgcgcgagaagcgcaagatcaagtcgccgaacatcgctgactcggtgattatgtcggccattctgccgatccggaagcccaaaggcttcttcgacttctaaacatagaaaagcccggagcgatccgggcttcgggtcttactcggtgtggttcctggcgctgagtgtcgacgaaacggcctcgccgacgcccagagcttcctgaccggccgcgagcgcttcggcttccgactcgacgttgaagtcatcaccttggccattgcctggcggaacctcgaccagcacggcttcttcgccttcgaaacgcaggtcataggtcttgtcgacggacagaccgtaacgagcgttgagcgcgtcccagagctgggcctcataggtacgcaggtcttgcagagctttctggtggctgagcatggccatgtcaacggcccgttgcagggtttcgtccaggacgttgaaccgaatgcgaagagcacgaatccgctcgacggtttccgcatccactacatgtctttcgatcattgcttttcacctttgctgaatgttacgttgtagccgttgtcggccaggtaggtcagggcgccttcgaaggaagttccgacgaggtgcttgagcttcatttcgcgttgcgcggccaaccagaatgcagttccggaaaactctgcgcggccttcggacaaaaccctgccatcaggcccggcgatccgtacatggacggaagatagcttgatcggcatcagtgaatacctccactggcttgcgacggcatgctttcggcgcgagcggcttcgcagtccgggcagggacaggcttggcggacgcgctccaactcgtcggcatccatgacatagagcttcccatcggcagtgtcatgtgccatagcgatgttcgggaagtcggttgcgctcaggccggcgacagtgcggatttcgtcccagagcaccagatgctcggcattcagtcgggcggcgagcgcttcgtgctctttagcgacgcgcgccatgaactcgtccatccggaatgcgaattccgcatcgatggcacgggccgaggccatggagctgagtcgaatcggttctttcttcatgatgattctcttttggttggtggttgttagctgctcaggcctattacagcctgagcagcatgatgaagatgaacgcaaggaacgcgaacggcacaagtatgccggacatcagctttgacaggcgctgcatctcagcgtatttctcggtagacattccgtgctgcgccgcctcggccgcgaagcgggctttcgcctcgataacttccgggcgcagcgacaggacatattctaaggcctcttcccgcgctttttcggcctcgaccgacctagggtcgcgggccgagacttcgctgtgccctggcctcgcgggatgggcttgcagcgatggagggagttcagcggccacgactccataatcggcacaggcccaagcgatcccaatgaggatcgcgaggatggactggacgattcgcagcatcactttgtcgctagggaagctcatgatcaatcctccaccgaccgaacgatttccatgttgcggccggcattggtcccggcattgaaggcgcgccgaccgtcgctatcgtccagacgcatgagcttagtaacattagacttcttgtagccaggatcaccgaaatgttcgtgaaccgcagcttccttcgccaccaccagagacgttccggcagaagataccagctccatgcgcttcctggtgatggattgaaggcgatagctgatttcctgggtcgcggccagcttgaattgcgcggcaacctttacgttgaaacgttcgtacccttgagacttctgatactcccggcacagacgatcaacggcctcgaccaaggagttgaacatgttcactgccagctcaacgtccgacttgtagcctttaaagcgtacggcatgaccccagcgcttggtagtgcttccgtcgcgggcactcctggacgccttagccgatgctctgtggttgttgacgccaccggcgaaatccatgatgcaatcattgtacgtcgccacggccaccgagaagaacttcatccagttcgggattgcggaatagtaacgagtggcaatttgctcatcgaactcttcgcgaatctcgccggtcgcttcgaagtcgtgaaggtcatatttgtccttcaatttcttcacgcgctcggctgcgatagcagcttcgtgcggactggaggagtcggccgccatggcggtcagtttgcggatgcggtctttcgccttctcgatggcttccggagtgaattcgttctggtcggtcatggtcggttccttttgtctgaagggtttcgcgtttcaatggagctattctgccttcattcagaatggaagtaaagcactttcttccactatttcggcatcgactggaagaaattccagatccaatcacctgctaccagcaagaggatgagggcgacaaagaacaggacggcggccgcgagctgtgcgcccggcttcagcttgggatggctgagcttgggctctgcgggaacggatggagcgttggcgctgcgaccgtcttctcccaggccgtagccgatgccgcgctcgcgcgcatggagcgacaccagaagtttcagatactcggtctgcttttgcgactcttcgtagatgccggcgacggcgaaccagagggcgaacacgacggacatacacacaacccaggcgccggtcagcaggagggccagcgggccgatgacgaagacggtggcagccaggacgattgcgccgccccagataatgaagccggccagaccattggtgatgtcgatacagaactttttcatttgcggattccttcggttacaggattgaggggatttggaactctgcgccaccgagcacatcggtgacgacttcccagagcgtcggcactgaccactggtagcggtcgaagtcggtttcaggatcgacgcccagcgtcacataggaagtggcaggccatttatgaacgctacctttccgcatgagagtcgccacgcggccgtcaccgagcgggttcgtcttgtgcggaacgtacgcagacatcgaatattgctgcccagcatcaacgatgaatctttgtctctggcgcagacatacagagccaacaggattccaaccgcgaccgccgcaggcctggcgagccgaagaatgctcatacccttcatgagtcatttcgccgaggcaagccgagcgatcttcgtaataattgatgttctccatcgatccaaccagcaccagagactcgaaatcgaatcggtgatcgtgaatggacgagtgatggacgcaacgccggcgcggcaactccgggtgccaaacatggaggcgccctgccgggagctggacctggatgaaccccaggccgtgcaaagtgatcttgtccttcagcggatcatggactgtactcatggataatcctcaatagcagaagtgtatggtgagagttacgatggccaagccggtcgcccatagaagggcgaaccaggccatagcttttatggttatgtagatcatccgaagaattttccggcacagatcgggccgattcccatttcgatggacgcgtggttggtcaactcgcgaccgcagcaggagcattgaccagtcttccggccgtaggcgactgccgattccatcggcttttcgaacatcttcagaacgtcgtcgtgctcggtatcggtgcagtcgcgactcttgatgaatttgccattggtgatacggccgaggtagatgtcgcccaggacgtacaagctaccggcgttccggctgtgagcgctagcctctttcaccacaacgatgagcggctcctcgccttcgccagccaggcgaattttcgggcgcttgattccagattctttcgccttctcaaacgccttctcgatgccggaaatgtccagagtcggcgcagcagcttcctgcgcggccactttctcgcgatacttggcgaagttttcgatggcgcgcttcgcagcagcgatctgattttctgtcaaggagccgtatttatacaacgactcctgaaggctctgagcgaagctgaaggaatttccagtccaccactcgacgatgtccgggtgcgcggcttcgaaggccttaattttgaggtcgcgctcttgcgcagcgctacagattttctcgatgcgcttttctgccgccttagcacggctcttggcgcgctgctccgggctggttttgtactctttgtatccgacaccgccgcaggcgaaacaggcgcgaccataagatgaagggccacggtacaggccggtgcctgcgcattttgtgcacttgtcgcgatacagcttcacttccttccgggagttcgggcgggcgcccatggacacgtcttccagcgtcttcggcgcttcgtcagtgatcgctacggtagcgaagtcatcgcccaggtcttcgaagccggtgaacagattctctgctgcgttcatatcgattctcctgtttggaaagttcgtttcgatgagttgactatacgccagaaatggaaaaacggtagcgatttctcactaccgttcgtcgggtcgaagataatcaatagatgtcgctattgatcttgaacccatgctcagcgccgtcgttgtagtcatactcagcatagctgtcgcagtagtcgttcaaatgctgaatgatgcctagaacgtcgttagcggccttgtgccgtttcgcggcgatggtcttggcgatgctatcgccgacttccagggtttcggccgtccggcgatggatcagtagacgactccaaagatagagccggacgcgacgaattatgtcgcgatggcgctccagtcgtccgtgcagctcttcaatttcttgctcgcgagatttcaccactcgtcgaagctgttgaacttccaattccaaatcggccttagtagccatgttcacctcagaaaggaaaatcgtctgggactccaggaagctcgacgattattgttgagcctgatcggtccagaatgcatccgaccgagccggccctgtggggatagggtctacacgaactataacaggtgacttccaggactatccgccaggtcgatcctccacaccatctacagactggtgggcgcttcgacttcagttttcgttcgtccaagacggcgcgtctgtcgcaggaaaggcagcgcgccttaaccgacgtaaccatgggtatagtcgatcattcggatgagatcatcatcctctgattccctcgacttcagaccgcccaaagagtcagactggccgttgcatttcgcatcgatatccatcgaagacaagaatcctgccgatactacggtgatatcaactttgtcgccggccttcttgaagccttcgcactcagcatcgagggccacaaccgcactcgcagccatgttcacatgacttatgaggtcggggaagatcacgggaacttcacgcgacatgccacggaccgtcatcttcaggactacatacttcatactcactatcccttttgtatgtgaggaaagaatttactgttttccggatggtggaagcgctcggccgcaggcggtcttccttccggacattgaatcgtcgaaggcgggaaaaccgcgcaggcgataatcgccgcgaggagtgcagcggatgtcgacatccagagggcggtttccaggctcacccgaacttccggacggcgcggcttcattcgctccaccctcttcccggttcataggatggtagactgccgccgcgaacccagttgtcccacatgcggttcagaccagtcggtggctggggcggcggactgtagaatccgggagtctcagtgctgctcaggaaataaggcgtgcaaacggcctggacggccagttggtgccgctcccacatcttatcaatcgctcttagcatgacgtcttcgcactgagccttactgtcgaaccgtctgctagtgtggtccggtatctggatgcatccgtctccagtgcaaaggaaagcagtagcaatccacacggtgatactcgccatttcgtcaccctctttagttgatgagcagagtctattccatctgctcgccaggagtaaagcgcttttcgtcgggataaatgccgatgatgtctgcgtcgagcatccaaatgtccacggacggatcgtcgctgctgatttgatataggttgtacagctcccgtccgccgacagcacgctcacctcgcggctcaaccgccagcaccttgccgtgtccttctccgtgctcgtccaggtatatgacgtgatcaccgacttcatagctttcttttgtgacgaggcgtgaacgcgagctgttctgcgattctactacccaggaatccagcacgccgcctttcacgtcgcgaaacaatcttgccgatttgtcgcaatcgaatacgcccagaacttcgccgtctttcaacacgatatgtacgattggcaaaagagtattcatgtttaatctccattggttgataattagagtctaatctgccgaaaagttcccgtaaagaattattttctcataactgattagttgcaactgttaatctgatgtatatgtttgaatctcttttgaacgtttgatgtttcccctataataagcgcacacagccaacaaccacgtggaactacaatgtttaaactttcctggatattcgggcgcaaaaaggataatgctgcctgttctgaatcggcgccggagaaagtcgcacaaatccctcaacacgatccgctcgaccccatgatcaagctgggaaggattcgcggctggaacgtcgagccggagaaagccccggtaattcgtagtgtgaaagatttcctggagccgggcctatctgtagcaatggatagtgcgtatggtgatggaccaactccggccgcgaaggctgctgcgggcggccagaatccctatgtcgtcccgactatgttgcaggactggtacaattcccaagggttcatcggataccaagcttgcgcaatcatttcccaacactggttggtggacaaagcttgttccatgtctggggaagacgcagcacggaacggatgggaactcaaatcggacggcaggaagctatccgatgaacaaagcgcgctgatcgcccggcgcgacatggagtttcgcgtcaaagacaacctcgtcgaactcaacagattcaagaacgttttcggcgttcgcatcgcgctgttcgttgtggagtctgacgatccggactactacgaaaaaccgttcaatccggatggaatcacgcccggctcctacaagggaatctcccagatcgatccatactgggcgatgccgcagctcactgccggctcgacggccgatccgtcttccgaacatttctatgagccggatttctggattatcagcgggaagaaatatcatcgcagccatctagtagtcgttcgcggaccgcagccgccagatatcctgaagcctacatacatcttcggcggtatcccgctcacccagagaatctatgagcgcgtgtatgcggcggaacggacggcgaacgaagccccgctgcttgccatgtcgaagcgaaccagcaccattcacgttgacgtggaaaaggccatcgcgaatgaagacgctttcaacgctcgcctggcgttctggattgccaatcgcgataaccacggcgtgaaagtcttgggtactgatgaaagcatggagcagttcgacacgaaccttgccgacttcgacagcatcatcatgaaccaatatcagctggtcgctgccatcgccaagactccagccacgaagctcctcggcacttctccaaaaggattcaatgccactggtgagcacgaaacgatttcttatcacgaagaactggagtccattcaagagcacatattcgacccacttcttgaacgccactatttgcttctggcgaagtcggaagaaatcgatgtgcagctggaaatcgtctggaaccctgtggactccacgtccagccagcaacaagccgaattgaacaataagaaagccgcgaccgatgaaatctacatcaactctggcgttgtgtcgccggatgaagttcgcgagcgtctgcgcgacgatccgcgttccggctacaaccggctcaccgacgatcaggcagaaaccgaaccgggcatgtctccggaaaacctggccgaattcgagaaggccggtgcacagtcggccaaggcgaaaggcgaagccgagcgagccgaagcccaggcgggcgccgtagagggcgcaggcgacccggttcccgccgctccacgcgggactaagcctctcgcgaaagcggccgaggaaggggccagcgaggccgctgaaccgccgtcgcggccggaccccaaggccgaactgcggaacttgttggtcgatcttttgtcgaagctccaagacctggacgacattaaggcgccggacggcgtagacatagagcacaatgatgcgcctggcgtaaagcgcacgtccaaacctggcgtgtctggcatggagccttcggtgttttcgtccaaccgcatcgtcgggcctcgtgatcattcggaactccagagaatcaaggtgaatggaataaccaccttgatcgaaaatccgcgcggaagcattcggcaaggaaaggatgggagttggcgagttcagatgaaacaccactacgggttcatcaagggaacgaaaggcgctgatggggatgaagtcgattgcttcgtcggtccgaatctgggatccaaacgggtcttcgtcgtcaaccaggtgaacaaggaaggtcagtttgacgagcacaagtgcatgctcggcttcaacaacatcaacgatgcgaagtctggatatctgtcctgcttccgcccaggttgggatggtctcggctccatccatgaagttgacctacccgctttccgtcgctggctggcgaacggcgacacaaccaaaccgtttggaggcgagtgatggcattcaaggcctccaaaaagcgcgaacgccgggcacctcttccggtcggaagagggaagcccataattccatcgtcaggaatcgaggcctggtatcgaaagcagatgaaggatatttccaagctcatgatcgccgactatcgaagcgagattgagaaggcgctgtcccagcctgcggccgaacggttcttcgccagcgacgaatccgttaacgtcctgttcaagatgacccttcgaagcctacagcagcgatggaaccgcatttttgaaggcttcgcggccaagatcgccccggagtttgtcaaccggaccgaagaagcggccaccgccgcgaccctgcacagcttgtctgtggccggcgtcgatcagccaagagctgcgtacaatgagagcgtcaggaataccctggaggcagcaactacttacaaccatactctcatcaccaggattcaagaggaagtccacgagaagatttatacatcagtaatgttgtctctgacttccccaaatccggaagagcaaggaacttccggcataacgaacgcacttcgcaaagtcgggaagttctctgaagatcgaatcgaactcatcgcaagagatcaaaccagcaagctttacagttctctgagcgatgagagaatggcggaaaatggagtcgaggaattcgagtggatgcactcttctgccggcaagactcctcgccatacccacctggagaaagatgggaaaaggttcaagctgaatgaccccagactttgggagggtccgaaggccgaccaggggccgccaggatgggcgattaactgtaggtgcagaaagataccaatcatttgatatcgataggagcgctatatgccgttagttcatggcacttccaatgaggctcgttctgaaaacatcaagcgggagatcgaagccggtaaagacccaaagcaggctgcggccatcgcttactccatccagcgcagtgagaaagggaagacggcgaaagattgttcgcctgagctcgttgccgatcttcgcgccctggtggacgctctgtcgaggctcgtgaaatgaaccgcaagacatgccggcgccgactcgtggtcgatgtaatcagggccaatattcacggcggattcttcagcctgaagtttgccgccatcgatttggcaatcatcggcgtcgccatcttgatgacttttggccgataatgctgagaaaatctggattctgactaaaattctagtccggatagccgcaagttaccgtttacggaaaatagcagtaatttggaaagcctactgccgcgaggctttaacagagctagttcctaatttccgatttagccgcgtgcttcaaaagtatatagcctgggaaattagaagtaacgtcccaatagaattcatctataagtaacgttataatataacgtcaatctatatgctctagacgtattgaaatttaatttttaatcggtaaattggtaatttgaattagtttatgagttgaaagcctcgcggcagtaggcttagacaaatcccgtcaagttccctagaccaaattaccggattttcgcggctgaggaaactggtaattagatcataatacaaattatagtgtaagttaacagtcgcgactacatctaattattgttccgcttatttacccttagatgtactgcgtatataatacagccatagtccacgactcttcgaattaacgatggcaaagtcgaaaagaaaaattgacgaaaatggatatatgaccatcgagggttgcccgatcagctcttatggcgttttccaatattctgctggtcaactcggtcttccgggcgatccgatgcggattgtcaacgtatatcgcccggagtctgccgtcagcgatcctgagtacatcgaatctctgaagaatctcccgttgatcgacgagcatgagatgctgtcgggattcgacgacgatgacgacagtgtggcccccgaagacaaaggggtggagggcatcatcacctccaacgcttactacgaagccccatgggcgcgcggcgatatccgcatctattcccgcaacatgcagaatcagctggaaaggggcaaagaagacctgtccctaggctatagttgccgctacactgagcaacccggcatctggaacggaacgccttatgaagtcgtccaggacaagatgcgcggcaaccacatcgccctggtaaaagaggggcgtgtgccgggggccagagtattggatggtctgtgttttgaccatctcagttttgatttcagaccatccgatgagggtaatgaaatgagtctcaagaaagccaagcagaagccccctgtccagcgcgtagggcaagctgctgactcggcggtcgaagagttgcgcgccctgtggccgaagctctctgcgtctgtccagaagttcctgggcgaagaggcgcaggagccggagcatcaggaaggcgcggccgctccggccgaaccgaccgacagcgagcacatgaccgagcatccgactctggaaggcgctcagaaggacaacgaagagcatgaagaggcgccttccgttgtcgatccggctgtggccgccgccgagtcggagcgtcaagaaagtgccgcatccgaaatgtccggtgaaggcgaagtcgccgaactgatctcccaggtcaaggccattctggctcgactggagggcacggcggccgaaggggcggacgaagagcatggcgaaggcaaagatgtcgtcgagggtttggaggagcagagcagcctcagcggctcgcaaaccgccagcgacgatggtggtgagggcaaggataacagcgaggaacttcctgaaatggcacagaagaacgcgcaagatgctgcaattcgcggtctctatcgcgacattgctgctaaagatcgcctctacaagcgtcttagctccgtggttggcgcgttcgatcaccgagctatggactcggctgaagtcgctgtttacggcgtgaagaagctgaacatcaactgcgcgaagggccaggaagctctggcactcgacatgtacctgaaaggcgtcgaggcctcacgtggcgcggccagccgtcaatcgaaagcccaggattcggccggctctgctccgcagtgcgccgagctggacagctacctgaagggggagtaactcatgttccagaaacaagtttaccgccagtacactcctggttttccgggcgatctgatcgaggacggcccgaagcgggcgcggccgggtcgaatcatgtctctgtctgccgtaaatccggctgccaccgccaccggccccaaccgcatcagtcgcgctttcggttacgccggtgacgtcagcgccctcggcgaaggtcagccgaagaccatcgcggctcgtgcttctgaagtcgtgatcggcggcgccaacttctttggtgtcctcggtcatccgaagcactatgccctgttcggttcggccggagactccctggctcccagctatgatctgcccgatggcgccgaaggcgagttcttcgacatggccaccggcctggtcgtcgaaattttcaacggcgccgcaaccgccctggacctggactatggtgacctggtcgcctatgtacccaacaacctgcctaccgccgacaacgcgcttggcctgccggcaggcgccctggtgggcttcaaggctggctccatgccgaccggtttggtccagattcccaacgcacgcatcgttaacgccatcagtctgccggcccagtcggcggggaatttggttgctggcgttaccatcgtccagctcacgcagtaaggaggcgtcatgagccagatcagcaagacccattcgcgcctcgcaggccgcaatgcgaaacctttcgacctgaaaaacatcaccaatgacgccgtggcgtctctgagtcgcatcggcctggtattcgaccacgccgtcgtccaggaccagatcaaggccttggcgaaggccggcgcattccgctccggctcggccatggacagcaacttcaccgccccggtgaccacgccgtccatcccgactcccatccagttcctgcagacctggttgccgggcttcgtgaaggtcatgaccgctgcacggaagatcgacgaaatcatcggcatcgataccgttggctcctgggaagatcaagaaatcgtccagggcatcgtggagccggccggcactgcggtggaatacggcgaccacaccaacatcccgctgaccagctggaacgccaacttcgaacgtcgcaccatcgttcgtggcgagctgggtatgatggtgggaaccctggaagagggtcgcgcctcggccatccggctgaacagcgccgaaaccaagcgccaacaggcggccatcggtctggaaatcttccgcaacgccatcggcttctatggctggcagagcggcctgggcaaccgcacctatggtttcctgaacgatcccaacctgccggcgttccagaccccgccgagccagggctggtccactgccgactgggcaggcatcatcggcgatatccgcgaggccgttcgccagctgcgtattcagagccaagatcagatcgatccgaaggcggaaaaaatcaccctggccctggccaccagcaaggtggactacctgtcggtcaccacgccatacggcatttcggtttctgactggatcgaacagacctatccgaaaatgcggatcgtgtctgctccggaactgtcaggcgtccagatgaaagcccaagagccggaagatgctctggtgctcttcgtcgaagacgtgaacgcggccgtcgatggaagcaccgatggcggcagcgtgttcagccagctggtacagagcaagttcatcaccctgggtgtcgaaaagcgggcgaagtcgtatgtggaagacttctccaacggcaccgccggtgcgctgtgtaagcgtccgtgggccgtggtgcgctacctcggcatctaaccgatgcctattcaccaaaggccggaaacccggcctttgttcactctgactctgactcggttgtaggggccggttagggcataattactaggactacgccaatgactgtttacatcgtttccgccatgactcaatccgtgtcttacaatgcgtatgacacctctgatccgtccaatcctcgcctccagcgaaagattctgattcgtggccgcgccggcatcgcatccgaaacttccggcttcggcgacatgatttccgacgcggccgggcgtccgatctggaccccgcagggcgattgcactgccgtgagcgattcggatttcgagctgcttcaggccaataagattttcatgcgtcacatggacaagggttatctgcgagtcgtgaagacagacatcaccagtgaccaccagcggatttccaaagagactcgcaccatggagcgcgatggattccagcctctggacgctgatcgtctgcagcagaaaatcaaggtgaccaccgccagcgcttcccaggaacaagagttccggatttaaccgagggtttcggtatggtgattttcgacgaacataagtttcgcacgctgtttccggagtttgctgatccagccgcttatccggacgtgcgcctgcagatgtatttcgacattgcgtgcgaattcatttctgatcgcgattcgccataccgtattctcaatggtaaagccctggaagcctgtctgtatcttctgaccgcccacctcctgtcgctgtccacgatgcaagttcagggcgcggctggaggtggcgtcactgccggtgggacccaaggcggtttcatcaccagcgctacggtcggcgaggtcagcgtggccaagctcgcgcccccggccaagaatggttggcagtggtggctttccgggacgccttatggccaagagctgtgggcgctcctcagcgtcaaagcggtgggcggattctacatcggcggtcttccagagcgccgaggcttccggaaggttggagggacgttctggtgatccctggtgcgaatcttctgcgaatggccttcggggtcatcggcactcaaattgtgaaatatcgcaagtttgagcagcgagtgaagaatgatcaagctcagtacgtttccatgttcgaggagcctttcgacctggcagcgtctgtccagcgagtccgacgcgatcagtatgtccagtttaatctggagttccaacggaattatgttatgatcttcgccaactttgagatggttgacttggatcgcgatgtggccggtgaccagttcctctggaccggaagagtttttcagctggagtctcaaggctcctggttttatcaggacggctggggagtttgcctggccgtggatatcggtgcggccaagctaactgatgacgggaaaccgactttctaggtgatgtatgtttgacggcgaactgatagcgaaaatggttgtcgagctgaatgcggcgatgacatctgctcaagaggctttgcagttcccggattttgaagtcgtccagaaagctcagccgacccaacagggaacgtcaaccaggccgaccatctttttccagaaactgtttgacattcctcgcggctggcctgccaccgattggcacctggacaacacgacccgcaaatatgtagaaataactcgacagcatgtagagacgactttccagatcagttcccttcattggcagaatcctgaaataactcacgtggttacggcttctgatatcgccaactatgtgagggcttatttccaagctcgatccacgattgagcgcgtaaaggaactggacttcctcattcttcgcgtttctcaaatttccaacgaggcattcgagaacgacaatcaccagttcgaattccatccaagttttgacatggttgtaacttacaaccaatatattcgcctgtacgaaaacgcagcatattcggccgatggggtattaataggcgtatgagtctgaggcgcgattcagagctaatcgccgcgcacctccagatgttaagagccatgcgcggcaggtccgtttcagccggatggtattccacggctcgatatcctgacaaggcaggcggatcggtcggaatacaagtagcgagaatcgcacgtctcaatgagtacggcggaactatcgaccatccgggcgggaccaggtatattagggacgccattgttcggggccggtttgttggcgttcggttcgtcagaaacgactttccgggagaaaccgaggtaactaagcctcacagaattaccatcccggctagaccgtttatgcgatatgcttggaacttgttttccgcagatcgcgccgcaatccagaaccggatagccatgaggctggccagaggacagatcactccagatcaagctcttgcccagatcggcctggcgttggaaggatacatagccagaagcatcaggaccgggccatgggtggctaactcagcatctacggtcaggagaaagggattcaacagaccgctggtcgatacggctcatatgcttcaatcgattagcagcagagtaacataaccaggagatcatccagtgatcagtcagagccgttatatccggatcatttcgggcgtaggcgcaggcgctccggtcgcaggccgaaagctgattctgcgcgtcatgactaccaacaacgtcattccgcccggaatcgtcatcgagttcgacaactccaacgcagtcatgtcttacttcggcgcgcagtcggaagaataccagcgcgctgccgcatatttcaagttcatcagtaaaagtgtgaattcgccgtccagcatcagcttcgctcgctgggttaacaccgccatcgcgccgatggtagttggtgacaatctgccgaagaccattgccgatttcgccggcttctccgcaggcgttctaaccatcatggtcggcgcggccgaaaagaacatcaccgccatcgatacgtccgccgcgacttccatggacaatgtggcgtcgatcatccagaccgaaatccgcaagaacaccgacccgcagctggcccaggctaccgtgacctggaatcagaacaccaaccagttcaccttggtcggcgccaccatcggtaccggcgtcctggccgtggcgaaatctgccgacccccaggacatgtccaccgccctcggctggtccacctccaacgtcgtcaacgtcgccggccaggctgccgatcttcccgacgcggccgttgccaagagcaccaatgtcagcaacaacttcggttcgttcctgttcgccggtgcgccgctcgacaatgaccagatcaaggccgtgtcggcctggaacgctgctcagaacaaccagttcatctacacggtcgccacttccctggcgaacctcggcactcttttcgacttggtgaagggcaacgccgggaccggcctgcatgtgctgtcggcgactgccgccaacgacttcgtggagcagtgccccagcgagatttttgccgccaccaactacgatgagccgggcgcttcgcaaaactacatgtactaccaattccctggccgcaacatcaccgtttccgacgataccgttgcgaacaccgtcgacaagagccggggcaactacatcggcgtcacccaggccaatggccagcagctcgctttctaccagcgcggcattctgtgcggcggtccgaccgatgcggtggacatgaacgtctatgccaacgaaatctggctgaagtcggctatcgctcaagcgcttctggacctgttcctgaacgtcaatgcggttccggcgagcagtactggtgaggcgatggtcctggcggtgctgcagccggttctggacaaggcgaccgccaacggcacgttcacctacggcaaggaaatcagcgccgtccagcagcagtacattacccaagtcaccggtgatcgccgtgcctggcgccaagtccaaaccctgggctactggatcaatatcaccttctccagctataccaacaacaacaccggcttgatcgagtggaaggccaactacacgctgatctattcgaagggcgatgccatccgcttcgtcgaagggtcggatgtgatgatctaatggtttgcggcggactcgatccgccgcaaccttccataaatggagtgaggagtaagcaatgatcaacatttctgcgttcggctcgatctgccagttcacggcaagcagaactttcccgaacggattcaccgtcaccgagttcgccgacgatgccgatcccatcgacagcccgccgttcaccgctgccgataccggcgtcggtctcaacggtgacatggtagtttggaaccgggcgaacatcctggaagtagtcgtcaacgtcattccgaataccgagggcgagcgcaacctggcagtcctgctggatgccaaccgcaccggaaaggacaagtcgggcgctcgtgatgtcgtcggcctggtcgtggcgatgccggacggcagcaaaatcacctgcaccaacggcaccccaatcgacggcgttctgatcaacgcggtggcaagcgtcggccgtctgaagaccaagccgtatcggttccgatttgaaaaagtgatcaaagccggtactagctgatgaagaaaattccgctgacagcagtccccaatcaagcgatctcatttaacgccggtagcagctattggaagattcgcctgtaccagaacatggacatgatgaatgccgatatcagccgcgacggcgtgatcgtttgccatggggtccgctgcttcggcgggattcctcttctccagtacagccgtcagtaccgacctgactatggcaatttcgtcttcgaccgcgacgccgattggacattgttcggcgacggcatcaacctgttctatctggacggcgccgaattcgccgagtatcaggcgcttgccacgaggaaagaatgagcacatcaacgatcagaaccgggacgaacaacgatatccttttggacgacaatggaaacatggttatcctcagggatgtcgaagcgtgcgcccaggacgttcgggcggcgatgctcatgcgcaccggcgaaaacattttcgatgtgaactccggtgtgggatatttcgaatacatcttctcgccgcagaaaagctatgatgacgctcgcaaatccatcgcggatgcaattttgtcctcgccggatgtgaccggcatcgagcagctggacatcgacatcaccggggaagtcttcggcgtcgatgctaaagtcatcaccatccacgggcctgttaccacaggagtttgaaatgagcacaatccgcatccaatacgccaacggcacccagctgttcctggacggcaaaaatccgccgctcctggaccctctaccctcgttcaacccgtctgtagaagatctggaaggcctggaccgcgaaaagaacaccggcaagggcgactcctcgccggccggtcttcccgttcccccggtaaacgtcgattccaatgtcgacaacggcggaaccatcccggctccggtatcgaccgacgctcctgcggccgaatcggccccggaaggcgcccaggaagctcctgcagcgggacaaggcgacgagaaaggcgccgaggaagccccgactaccgccccagtagaaaaggccgaggaaacggcctcgccggccgctgaagaggaagccccggctcccgccaaggccacctctcgcaaaaccaccagcaagtaaggactcgacatgatcaacgtcagcggcttcggcacaggaattgtaatagtttccgcctcatcgttcccgatggggttttccttgtcgaagttcgctgatgatgagagtccgatatcctccaaagagctggagccgttcggatatgagatgctttatgacggcggcctattcgcctttgacaaggctgctcctctggaagtatctgtatccgtcatcgcagggagcgaggatgatattaaccttcgcatccttctcaattccaaaaagggatcattccgatttcttccgggaatcatcccggatatgacgactctcgtggccactcttcctgatggcggccgcaccgttctgtccaatgggactatcatcaagggtccggccatcgacaccatacagaacaccggacgacgcaaaggcaacacgtacacttttgttttcggtagctatcttggcgcccagactgcgcgtcaagccatttctaacgttatccaatcggtactggaggtggtctgatgttagggattttcaccagcctcctaagttcgcgatctttttcgattgtggaccaaaacacaaaccagctagttgctgcggatttgaggataagccgggtcaacacccggttttcttctgtagggcaacgccacatgctggaagatggcaagaccaagatggattccagaacgatccaccctatggaaatcatcgtcgaagtattttgcccttcaattgatgtcgtcgatcagatcaatcaattgctcctggatcgcgacactctgtacaaagtcatcactcgcggcatggtattcgaacggatgatgtgtaccagcgaagcgctcaatcagactccggatatgatatcggcgactcctgcgcggctgacattctcccaagttctcgtccagaatcccaagcctataatgttcagaaatgcaggggactcttctatgatcgaccgagggctggccctagctgaagacgtggttggctcggccggcgatctgttcgactacgcagtaaacggcgtccagaacgccgcagacttgttctgaggtgccaattgaactctttcctcaagtctattctcaacacgcctactctcaccatacgtgatgatgttaccaaacttcctgtctggaagagtcttcaagtcaagaaagtggaaatttactcgccggcttccgtagtgtcgaaacctctggcgacgaaagaccagacggaagctcaagtgtacaccgaagctctggacattgatgtgaagaatggaaagatcatccaaccggtgcgactccgcatcaatgctatctgtccggacctgtccaccgttgaaagtatcatgaacgctttcaatgataacacctcgactttcgctatcacttctaagtcgatattggccgataaaatggccatcatgacgctcgatgtagatcagtcgccagacatgttgaacgcggctgagatcaatatggaattcgagcaggttgagcctccagtattgaatgaattcgatcctgcgttccctcaagatagtccgacttatggggtacagattcaatctctttctgatgctaatttgctggatttgggcgccatcggcgattcgatatcttcggccgcaaaatcgctatataatcgcgtgaccagctacttctgaggatgtatcatgcttgaaatcaatcttcccgatggccgtcaaactcgcgtacaaatcgaggcgtggtcggcattggatggctgggaactccagcgccgtttcgtcgaattcgctgtcagccaagattccgacttccgccgctctttcaccatggaaatcctgggctatgcgaaagtgctgcttggcgacgatgacaccggcattccgctgaccaccgcggcagtcatcaacaaccacctcggccactggaagaacgtggaactggttttcaactctgttctcaagcacaatggcatcgacccggccacgcacgccgaccggccggactattgggaacaagtcggatcgcagatggccatcgcatttctggccgaggcgtccaagctcattggtccagcaatgaagatcgccgaaggactcgccaacaagccggagtgattcatgtctagtgatttggatgaattcatacttcggtatgaggccgatactgccagagccgagcgcaatctagagcacctccagaaccagatcaggcgcgtaaacagcgcatcgacgagtggccttcaggatttgcgccacttcgcagacggcgcggccaccgaactcggccgagtcgttcctcagattgattctgtgacgagcgcaattcgcggaatgaacgcgcaactggcaataggcgcaactggcgtggccctggtcgcggccggcgtcaaggcgttcatgaacaccagggaccagtacaatcagcagcgcatccaggcgatggacatcggcatcgccccggcacgcttggaagagtaccagagaaaattcgttcgccagtccggtggaaccatcagccgcgagcagggcgcggagatgaccaaaaatctggcagacactttccggcgtgcttatcgcgatatcgggcgagtcggcccggaagcgcgaattctgcgtatggcaggcgtcgatgtcgggagcttccaaaagggcatgcggccgctcaacgacatcattactgatctggccacgaaaatggccaagttgaagccggacgaaatttctgcctacgctgatgcccttggcgtctcgcgagactacctgagcaccctggcgaagatcggcccggccatgggaaaagtcactgagatgacgactgcggaactccagtccagggtccagggcgagtccaacatccagaaattcaacgatgccctggcgaatctcaaccagacgttcactaccctggaaaaccgagtcggcgaaaagctcgcgcctgcgttcaccaagctgatcgaaatcatcgacaagatagtccaggctattcccaatgaagtggaaagcttcgcgaaggacaccaaatcccgttgggaagatggagtgctcgggaaggcgaccgttggcagtgatatcctatccctcctcagccccggcgccctgctcggtcgcctggcagcgtgggggactcgtcgcggcatggaagaatcagggctcatcgacaaggacaaggttcccggcgctcaaaccagcgaagacctggccaagaaacaagaagaccaggacaaggctactaagtccatgaaagagctagagaagctggctgaccagaccacgaagtctaccaatgattttgcggtggcgatcaacatgttcagtggcgcggtatcgtcgttcgcgaatgccgttgacgagcgccaagcttgggcagcctgggcgggggaaattggtcgggcggtcggcatgggaagcaccgcgccgacttcgcgggccaccggcgtctatccgcacgcgatctatgatcagtcgaagagtggcgcggccggacaagtcttcggcgagccaatcggcgcccagtctcttcgcaatcgcatgttctcgccgcagcgcaaggccgagccggtcaccgttccatcgtacatcaacgacatcatcaaagatgcgtcgaagatgtacaacattcctgagctggacatcaagaaactcatatacaccgaaagccgattcaacgccagggctaccagcgaagccggagcgaaaggcctcatgcagctgatgccggaaatcgccaaggcgtatggtataactgacgtatatgaccctcgccagaacatcctcggcggaacgcgcctattgcgggaaaacctggatcgagccaatggcgacatgcggttggccttgacctactatcacggcggcctcgatccgaagaactggggaccaaggactcgcgcatatccgggtttggtgatgagcgctccaatcgagctgatggaagaggctcagcgcaagcagaaggctgcggccatgaccgtcgccaacgagacgttcgccccggaaggcggcgacatggacattcgtccctatgatggcgggcgactggaaaccccagaccagggcaagaaggaagatgagcgccgcgaagcccgtcgatatgacgacagggttgtgcgaccggaaattcgcatcatcgaccgcatgccagaccgcagcgacggcgaaatcctcaagatgtctaggcgtcaagaggccgaccgggcagattctggattccggaagttcccgaatcaagttcgcggcgagaccaagcagaacatccaggctcaactcactgcaggagccatcgcgcaagtgatcggcgttaaccccaaccagatcatgcgccgcgaaatcagccgttctgacttgctgttcggatacaaccaagccatcctgggcaagcaacaggagatcaaggccgccgcgaccgaagccaacaacgtattcctgtctccagccaagcttgccgaagccacggccaaggtgaacgccgcatcgcgagaaatggatattctcaggacgtacggcgagcaacttctgaagagcgctccagagcgcggccaggagctgaccatcggtcgaatcgatatgttggtaaacgttaccggcgcgaattctccggaagaggctcgcgagatattcagtaagcagactgcagaccagctgactacggcaatccaggacgctcaaaacgattccgcaactaagatactctactgatgaaaaagagaattctgcgagtaacattcaacatgccttatggacccgaagtcatccgcgaagatctggatgttcgggtccggattatgaaggctgcgttgcggattcagaaccgggcgacgatggaaattttcggcctcaccactcagctgcgcgagtctcttctgtcgcagttcaccgcgtggaagcaccggcaacgtcaagtgggcagggaagatgaattgatgatcaaggtgtcggtggaagccggctactctgaccaggggcgcgagcaagtttccagagtctttgtcggcgaagtcgccattgtcgatatcatttctccgccaccggacattggaatccgcatccagtgctataccaggcaaatcgacaggacgaagaccattcggaatatgccgccagccaacacgacgtttgtcaagttcgtcgagtggggcgcgaacgaaatgggattgaacttcatttgcgataccagttacaacgatcaagttctgaagaatccgggccggtctatcactgtcgcgtcggcaatcctggcgtcgattcaggatatgtacatgccggacgtggccgcgttcgtcgatgatgacattttgatcgtgaaggaccgcgacaaagtcattcgaccggatgaggtgaccaacgtcaactcgttcgttggaattccatcttggtctgaatggggcgttgaattccagtgtctgtttgagccatcgattcgcgtggctggaggcgtggcggtcgaatcgctcatgaacccaagcgtcaatggcaactatgtaatcactgctctggaatacgatttggccagtcgggatcggccgttctatatcaaagtcatggggagcccagcagcataatggccagggaaatcaaaccgttcaacatgttcggcgttcactatacttcgcggcaattctctgctgtcgatgggctcagcatgatgtcggaaattcagagtgtgccgccagaagaactgctcaagggaaccagtgtattggcgcatccggaagaccatccggaaggcatctggcttccattgactgctgcgaacatcaatctttatgtcgttgatcgagcgaaagtaatagctcccgtacaagttcttgcacttctgtccgaagtggtaatcgactggaactttggttttctcaaagactggaccggagtcaagattccatccagatttgtcgaagatatcaaaagcgtgaagacggcacattcaccttctgtagttgcgagcttggtcgcgaacggctcagcctctatgcgcgagttggaagagtattattcgactcaagatgcgtttaagatgatagacatcatgacggcgaagagcgtgaacgaggccttggcgtccgaagcatcgcacaacagaatcaaaaagggataattcctaaccgggcctgggaaggctatactagacctgccaaatcagaggctttcccatgtccaatatttctctaacatccgcaaaagctcccgacaggacgcgactgatcgccgctcttgacgctcggtcgcggcgggatgctctagatttcgaagtgatgataccggctcaggttgttcaatatgaccgggccgagaacatcgcgacgattcaacctctcatcacctgggttgacacggaacacaacgccgtccaaaggcatcagctggttgatattcctgtaatttccatgggggctggcggcttccacataagtttcccgattcagcaaggtgacataggctggatttatgcggccgaccgcgacacgtctcagttcctggagtcgttgtcaatgtcgaagccgaacaccggccgcatccataagttcgagcatggcctgttcatcccggacgtattccgtcgatacaccatcaattccgaagattcggccgctatggtcatacaatcgacttccggagcgaccagaatttcgattcgcggcgataacatcaagataactgcgccgtcgaacgttactgtggatactccgcaggcgaacttcaccggcaatgtgactatcgctaacaccctggtcgtaaacggcatcaacgtgaacaaccacggccacctcgaaaacaacccgcctgatgcccggacgaaaggcggcatgattgcttaaggagattttcatggcaagttttgatttttctgatttaacagcgggggggggttgtaatggctaactacaactacatcgtcgatactggtgtgatagtcgcagataccgccgacgttctgagcgacgttgaggccgagttccgcgccgccctcggtgccaatatcaacttggccgcgagcactccgcagggatcgcttgtcgcggccgaggccattgcccgttccagcgtcatgcggaatgaagcgcgaattgccaataccataaacccgaacgtttcattcggaacgttcctggacgcgatctgtgccttgatggggatcgagcgtggttctgacctgtcaaccttcggctatggagttcaagtcaccggccgcagccaaacccgcatttccacagggtctagggtccagactccggccggcgcgatcttcacagtgctgagcgatgtcacgatccctgctggtggtgtcgcgaccatcgatatcaaatcgcaggagtatggcaacattcctctgccggtcgggaatctcatcatcatcgacggcacaattggctggtccggagcgaaagtcatcgcctccactcgcgtcgatccgggcagccgccaaatgagcgatgcagaactgaagaatgcccgcgttaatcgattggccatccaaggccgcaactcgaccatggccatcaaggcgtatgtgagcgccgttccgaacgtcacgtcggtgaacgtaatcgagaacaacaccggcgccgttcaagtggtgaatggagtatcgtttacccttccgtatgctgtttgggtctgcgtcgccggaaacccggataaacaagcagtcgccgatgcgttgtgggccgcccataacggcggaactccatgggactatggtgcgacgaacaacggcgtcccggtggacggtccgaatggcgttcctgtgcgcgatccggcgtccggtcgaaagtatgtcgtgaagtggaccactccaattatgtacgatggatatgttaacgtaacagtccagcaaggttcctcctctgtagctccggaagccattcagaacgcagtggtcaattacgcccaggggaaagtggaaggggaagaggggctggtggtgggcgcgagcctgtcggcattcgaagtcgccggcgccatcgctcgcgaaattcccggcatctacatcaaactctgccaggtcgcgtgcgtcgcggctggctcgccggctccggcgccgggcgatttcacttcggaatacgtcatgagcgcattcggccaggctaccatttccgttggtaacgttcgggtgactttcgtatgactctgcctgcgtacaattcggacatccaacaagctctgaaatggctccataaccaggcgcctggaatcaccggcctgatccagagaaaggcgcaatggtatgacagattcagccgccaattctgggccaactgggagcgcgacgttttccacttgaaaactgccaacccgttcggccttatggtttggtgcatcatcctcggcacgccttcgaaagggttcggcctttatccaaaaaacagttcttgggcattcggtcggctacgccagaacttcatctatagcggtacacaagttccgccaccggcagacgcatcgcctggcggcaacttctacggtggcggcaatgccgaaattctcaacttggacgaaatcaggaaagtgcttcagctaagatatgtagcgctgatttctaacggctcgattgcatatatcaatcgcatgcttcgttacatattcaatgatgatgagccatgggacgaggcgaccggtctgtacttctatctcatggactcaaccggcgagaatggccctgtggagaacttggcgatatatcggaaagattgggaaggtatggtgctgttgtccagttcgcccagaacgaaccacgtgctgacatcgacccctgccagcgacgccgattggccgggagtcgatccggccgcgagcggtattccggtaacggtcgaaacggcgtccgctacggccccggacggctccgctacggtgtgcaagcttactaagccggccgggagtaccgcttacgtctccgcgccgatagatgggccgctggggtccggtagcactgtaacgttctcgttcttcgcgaaagccggctccacccgtttcattgcaattcagtcggctgccgatttccccagtcgagccgatgccgttttcgacctggattccgggaacgtaatcagcgatcagatgctggacagcagcgtggtaagcgcccgaatgattcgtctggaaaatggctggtggcgttgcgttctcacgaccaagaccgtcagctcttcgttccgcgctgcttacgtcgctccggcagaaaccaacttcagctggattgattcgaattccagcgcggcgattgacgtgcttatctggggcgctcagatcgaactgggtgatactccaactggatacttggaaactaccggggcgcccgtaaccatgaccgattatgttttgcagaacgcccagaccggaacagtcaagttcacacagccccttccgaccggagtagaagcgtattggactggagactggaaaggcgggactgcagcagaaccggccagattcgcagtcgggaatgggactcaggatacgtttactctgtcagaccccgcatacatcggcctacccaccagtggggcgttcaagctagaatacagggttggtccggcgcttaatctgtcgccgcaattgatcaacctcatgaatgaccgggcagttggtattatgccgacttgcgccggttgcgatgtcaaagtcattcaggagtaatgacgtgatcacacccgaactgatccccagtccgtttgccgctcagggcgataaagacccgattccacaaacctcctccactggcttcgcaaaccttcgcgacggctatacgccggactacgaaatcagcctggcgtcgaacaacccgcaggccaaagcggtcgagcggaaaattcaaaaccaactcttcttcatcgcgacccagaacgcacaggcgtggcagcgacaaatggcgccgccgtggtttcagggcatgcctggcggctacgaacagaatgcagaagtcgtgcgcgtcggaaatgacggcataatgcggcgttatcgttccatggtgaatgccaatgcgagcgaccctctcagcagcacgacttgggaagaacaacccgcatggtcggcgatgcgctccaacatcccgatgccggccggaggcccaggcctatcttctggcggagaagtcatcacgaccggccgcaacttcaacgacctgttaaatgggacgtgggagttcttctctgattcagtggttatcgcttctcagaatgcccccgtatatccggcgtccgctggtgccgctgctggcatgttggaggcgaaatcttggatatccgggtccaatacgttctgcgttcaacgctacactgaccgcgtcgggaacgtcgctgtgcgcgggcttaatgccggggcatggaccaactggatgtatgctgtaaacgttatggccctccaacaaggtcgagtgacctatggagtcgcggccggcccggcgaacgcttacacgttgacgctcgttccgcagctccaaggcggcctggtggatggcatgattcttcgggtcaagttcaacaccatgaacaccggcgcctccaccatcaacgtctccggactcggcgccaaagccatcgtcggcgcggccaacttccctctcaccggcggcgaacttggccaaggactcatcgctgagcttgtattcgacgcagcaggcgaccgctggagaatcctcgcaggcgcgccacgcatccaagttggcaacgccgatcaagattaccaggcccccagctggaaacaggtgaaggattacgtcgcgtcccaaaagctgactgaagtggactgggctgacgtcgtcaacaagccgaacgtcgctatccaagacactacgccgtggttcgccaatctggagttgtctgacgctcggcctttcatcgatttccacttcaacaacaaccgcgccaaagacttcgactatcgctttatctctgaagctgatgggtcgatggcgttctactctcgccaggggtcagctggtcctacccaggatatcctgttcagcaggtcgaatgttacattcctccagccgcgactggatgttgcgaaaaacctcgcgtacatcgcgaactctggtcccctttggcagaacaccactgccgatcagcccggttggaagttcacattcgcgcaaggcgtggacgcgaacaacaacgcggtgatcgcagtcaataccaccaatcctgacggctcctatcgctcacagataatgcgttgggactgggcgtccacgaatgtaatcttcaacaatcgtccgcttttcgccgggcaatatgttccttgggattctggtaacttcgacccttcaacaaagttgacagtcaatgccacgaaccagatcgccgggcccaccgggattcggaacaccaacggcaacaccggcaatatgaacacatggggttccggttccacgacggcatcctatggcaatgctgccatccagatcttcgggaaagggggcggtgagcctgccgcgatctattttgacaactcccagaccggatggtatctgggtatggacaaggatggacagctcaagcgggccggctggtcactcggcaacaactcttatgtcatcaccgatgaattgaacatcagaaaccacatcaacggtatggcagcaaggccggtttggggcggaaatgaattctgggggccgtggaacttcaatccgaacactaagcttacgttgggcgcattcaacgatagccaacacaccaggatggtaaacagcgccgcgaaggacgtagggatagccgccatgacaagttatggcgacgcggctatgtcgttcttcaactatgaggcttcgacgccgaccgggaatcgtgctgctgtaatttcgtttgttcgtaacggggcacgaggcgttctgttcggcctggacacggacaacaagctgaaatggggcggctattctctaggtgccgtcgcgttcgagattgccgactccaacaacctcatgagcctgtggtcatcccacgctgccgcgccgaactggaacgggcagaccatctggaggtcgggaaacttcaacccagacaccaaggcgactttggcagctcgcaatacgacgtcatcccctacaatattcagttatggggcgtccggaatcgcatcaaccggacaggtcggtgcgttggttgtggaaaacaacagcgtcaccaataccgcagccgccatcacgttccattcgccgcagaaatatcaggtcaacttcggcctggatgcggacaacgtggtaaagatcggtggcggcacaatgggcggcgtagcatatcccatcatccactccggcaactacaacaactacatcaaccaggcgctggttcaggtaggtcttggcggcgtcggttcctacgcgatccttgccgtatttgacacctccgcgccggcagcgtccattgcccccggaacgatcatggacagttccaagctgttctattcgtcctgcgattcgacctatcgcagcagcgccagtccgacgggcacctggcgctgcatggggtatgtgtataaccgagactccaccaacggcgactcggcatccctattccagcgggtaacgtaacatgaaatggacgcgaatcagaaaccctcgttggctggatgagacaaatattcacgccatggttactttcgaggggattggagaagttcctttcaccgccaatccgcacgacgtggaggcccacggaagggccattcacgctgcgatcctgtccggggcgcacggacctatcgccccagtagactcgacgcgggagcaggccttgcaggacgctatacgagcaagggaaaagcgggctatccttcgcgatacccgatggcccatagatcgtcacgacgagcagaggcggctgggtatcgaaaccacggacgggcctgggctgatagcagcccttgttcactggaggcagcagattcgcgattggaatagcggggatcggccgcgacttcccatggctctgaaagcaatattcaaaaatcaggagtattgatgaaaatcacgaaggatattctgatcatcggaaccgggtgcaccacggatcgggcgatcaagtggctggatgacgtccaggcggccatggacaagttccacatcgagtcgccgcgagccattgcggcctacctcgccaacatcggcgtcgagtccggtggcctggtaagtctggtggagaatctcaactacagcgctcaaggattggccaacacctggcctcgccggtacgcagtagacccgcgagtccgcccgtatgtcccgaacgctctggcgaaccgcctggcccgtaacccggtcgccatcgccaacaacgtgtacgcggatcgcatgggtaatggatgcgagcaggatggcgatggttggaagtatcgcgggcgcggcttgatccagctgaccggaaagtcgaactattccctgttcgccgaagactccggcctggacgctctggagcaaccggagctgctggagactccggccggcgcggcgatgtcttctgcctggttcttctggcgcaatcgctgtatccccatggcggagtccaacaacttctccctggtcgtgaaaaccatcaacggtgccgcgccgaacgatgcgaaccacggccagctccggatcaaccgctatatgaagaccatctccgcgatcaatcaaggctcctgatattcaaccccaaagaaaaggccgcttattcagcggcctttttgctttccggctttgcctcttcaaccatcttgacctcaaccggcgcggcggactcctcctgagtgatcgagtccacatagttccctagtgaactcagaacgccgattaacagcgctctcaccaccttgtccttgactgtctcgcctatgatcttggtcagaacggatattaactcttcccggagtctggggctgattcttggccgaaagcgcttgcgatgctctttgcgtttcatgtttagtcctctgtctgcggtcttctcctcaccccgataattgcttggggatgctttgtgttaatcggaagggtcgggcgctattataacccgtcgaaaatgctagcgcttaactgtttaacgatacgcaccgcgatattaaatcgccttctttctggccgaggaactctggcggccgggtccggtctaaggcctaatttgtcgacatcaaaacgagaaaacccggatcgcctgtagggtaaggcgtccgggtttatttcgatctagtgtccgctagaatcagtggcttccgccccatccgtccagccagcaatcgaagacggcgtgtctcggcttgtccttggcgccatgggagaagtgcttgaatcggatgacctggcccttgaggtattccctgtcattccagcggcgctgtttctcgtcgtgggtcaggctggaggccgacacgttgaaggtgacgccaggccacagacgttcgttgcggcagacgaacgcaccgaccattccggacggcgacaggttttctgcgtggctggagcgggccgtgtggccaagttcattgatgaaagcttcattgttgttgtgcatcaactcttccacgtcgatgatctcagcttcatcgtagtcgtatcgcttgactttcacacagtgcccttccttggcagtcgagcgaccgaacttgtacagtccatcagcgcgcttgcccatggaaccttcgaatcccagcattgtgtggcggcgctcgacttcgctgaactgttcgatggaagtcaccagttcctgctcgaccaggtgaatcctctcatagccgaggcagtgacgaaggaagttcacgcgctcggccgccctggctaggcgatcttcggtcggtgcgcgaggatcggtgaaatcatcgaacacatggaaagaccagtccggctcaccgctgtggcggcgaagatcgccggacgacttctggaaaactttcgggtcgctgatgtcgccgcagaccagctcgccgtccaggccgttgaacagcttatcgctgaggtattcgtagatcgattgattgttctgccgcttgagttgacgggtcagcgcctcgccttcgaatacgaagcagcgaaatccatcgatcttcggtgagaaatacatcggcagttggccttccagcagcttcgggtcaaaattcgatgcgagcatgggtttcatacagttctccagaaaagaagcccggcgaaccgggctaaatggcggtaagccggctcagatggtttcgttggcgtggttcagttcggccatgatcgacgcatagcgctcgtccgactccttgatgaacacgccgtcgtacatgacgcctttgcgatccttgatggtgtcgtaggccgcagcgtagcaggcgagcatggtagtgtcgtgctcttccgtcacatcgaacagagtcatgacggccaagaccaggctcttgatggctaatccatgatttccgcgtgccagcgcgccggccagatgtccgaggtgctgcaaatcgtcgccgtaggtgggatgaacttcgacagtctcgctgaagacagatagatgatcgaacagattttcaccgagttgcgcggccatgatcgtggcaaccaccattacgtcgccgatgccgtctttcacctcgactggtttgttataaacccaggcttcgcaaacttctgcgaactcttcgaccaacttcaggaattgatccttggccgaagagcctttgatcaggttccggtcggaaccccatttaacaaccaggtcgtgaagttcgcgactcatgatttgttcgatattcattctttcgattccttttggatttgggattttactgcgttgattatggacgccgtgctctggcgcgatccatccttggtggtgccgaagtagaaggccattaccgacttcagctcggcgaaccaatagccgatgatggtgccgatggcgacagaggatgtcgggtccatcagagcctcgcggccgaatgtgaagattgcgatgatgatgagaatggagcctgtcagaagagcgaatgtaatcgccgggcgaacgaaatcgttctgctgcgccgcaagcctcctcgcagaatccctgtcggccgcctctgcggcgaactggctaagctcggcctggagctggttctgctcagactgaaggcgattttgttcggcttgaatcgcaagctcctggagacgaacgcgctcggcgctctggagttcggcgagacgcgctagagcttccggattcgcgtctagagcgctagcgaccgaggctgggtcggccttcgaccccagcgccgtcgcgacgatagcgcccacggcggcgcctgcaggcccacccaggagcgaacccagagccggggcagccgcgccgatcttactacctatgtctttccagtccatttcgactcctcaaaagaaaggcgccattacagcgcctttctccggccggtgatttagaactcttcggcttcggtcgcatcgccgacgccaccggcgtcactgcgaggctgttcctgcttgctgtagtccaccttcacctcgccgccgacgaacgacttgtacaggtcggccgcagccttgaagtgatccgggttcttcaccaggccttccagctcgaactggacgccggaccagctacccttgtcgttcgacatgcctacggtggtcatgcggaccaggttggcgaaagtcggcggggtgcgcaggccctgcggggtctgaacctttttctgggacagcgcggtcatgagcttcttcgaggccttgatctgcgaagacgacagggagatcagagcctggccgaaatcgccggtgtccggatcgatgacgatgacgtaatgaccacgggtgtcggcgaagtagtcagacttcttgtcgctgaccgaaccgtcttcgttcggcgcgtacaggcgtccttcgacttccttcaccttggtcgggtctttcatcatttccttgaagtcttcgacgctgatggcgcccttgaaaccgccctcggcctcgcgaccggcccagcggatgaactcgcggcggtacgcggccggaatgatcagcaggccggtcttgccgtcgtaaatcttgccggtgacggtgttcaggaacatgccggccttcgcgccttcgatgtacttcgggtcatcttcatcgacctggggagacatcttctgcagaacctggatgaaggggatggcataggactcggcatcggcgccttcgaagcctgcgccgtcatacgatcccaaatccatgaagtcgggaacttcggtagttgcgacggcgccgccaccggtggcaactgctacggccttggtttcttcggttgcttcggaagtttcggttttcttaccagccatgttaggctccttgtttgtcgaatttcagttatcgctaactgtgggtttataataacggaagttgcaactaagtaaagcaaattacatattaagatttgctctttttcaccttcggtttcgtgattttggcctctttgtattcgtgcacgccgatgaaatctggcagctcttcgcccttctccaaatactcgcgaccgaacgcctggagggtctggtagtggacatcgcggttgatggtggcgtcatagccggcctcaatgatagcctcggccgccttcttcgcatcttccatttcgccgcgaccgaattcggccagaaccttggtcttgatgatgccgtcgttgtcggtttcttccagccacttccagaacttcgatttgttctcttctttgacggaaatgatggccttcggctcgactttgaccgtgcgaccgtcagccagagtagtggtcttttgaccaagctcctccagcagctccggaatggtgttgcgcttgagggttttcagctcctcttccttttcggccagcgccttttgaagatcgaggatttcgacgtccagctgcgaagccttgtccaccaggttcagcagtcgatggccgatgtcggtggcttcaaccgccatttcatccatgacgccaaaatagtcgatttcgcccggcgcgttctctttcaagtattccgggatttcaagctcttgctctttcatgtccgcctccaacttagtgatgttcccttacttgaaccaagtattgagtagatattatgccgcatcttccttgatacggctactgatttacatattaaatttcgtcgcgagtgctaacgtcagcctcaaacacgccatcaacgacataacttgccaggttgcgtttccactccaagctgacctggattttctcgtcgatggaatccagacagatcaggtcgaagtacagaaccgagttgacggtgccgattcgatgatttcggtcttcggactgcatccgcagctcgttgtcttcgtcggtcgtgtagtagatggccacgtctgcggccgtgagcgtgatcccgatccctgctgcggccgggttgcccaggaacacctggacgcgcttggcctggaaatcgtcgatcaatttttcccgctcggcctctttggtctcgccgtagtaggtgccaaacgaaatcccttgggcctccaaatacgccttgatctggtcgatttcctgaatgcgcatggcccagacgatgatggaacgctccgggtcttcctccagcagaccctccagaagatcagtaaacacggcgaatcgcgggttgtcttcgggcggcaggatcaccggctcaccatagacgttgatatagccggacgcaacttgcttgagcttcgaacgcgctgccgcagcatcgaaagatacatccagcatgaaatcttcgttctggagaacgaagtgatagtcttcttccacgcgctgataaacctttcgttgctccggcgacatttcgaagtatatgcgcttgtacaccttgtccggcaggaatggcaatgcttccttcttcgtgacccggaagctgtgcggctcgatcagggatcgcagcttgtccaggttccggaataccgggcgcccataatcgtctttttcgacgagttgcggcggcatggtttgcttcccttccagcttgcgcatgatagcgatcattcgaggatcgtcactgggcaccaagacggaaaattcggccacaaacgcccgataggatttagtccccagaattccattccgcaagaattggaactgcatgaacaaatcggtcggtgcccgcgtcagaggagttccggaaaggatgcgacgggccacggccttctcgcccagctttacgatctttttcgcacgcttggcttgtgggtttttgatcctcgttgactcgtccacaattgcgcaaactttgaatgtatcaaggaatcgctcgacctcatcatagccagcctggtggttgattgcgtcaacgttgatggcgaagacgcgaagaactttttcatctgcgaacgtctcggaatacagacggtccaagcgcgccctggcctttttggaagtcggtcggccgcgccaatccacgctcaaagtcttgatcgcgacgtgggtgggaatctcgcgcagaatccagttggtgtggacgcctttgggggcgacgatgagcagcgcgtccacgcgcccctgtaggaagaggcgaacggcatcggccaaagtcgtccaagtcttcccggtgccctgctccatcaggtatgcgaagttccgtttgttcagggacgctgccagggcattgaattggtgctgcatggcctcggtcttcatgcccttgacgggatatgttttggctttcatttgttctccaaatcggcgaggaactgaacaatgttatccagtccttctgcatagctcgcaacttccaccaagtcgcggctgttaagctcgaacaaatcgaacataggattcagcagcagccaatcggttccgatcttggccaggacgaagccccggccaccccagccgatccgctcccgaagaaaagggatttgcccaggttcgaaacatctggccattgggcaggtggaagcgcgtttcggccactcctccaaagccttgaactcgacccagaactggacacctcgacgattcaggcagatcgaatcggacatgccagaccgccgcgtctccagaaagtcgatcaggattcggccgagcgagcgctgcttaaacgcattcgccgctttcgtttcgcgatcattcatcaccttcgccctctttggaaactttctctgcttgcgatgccaactttgacttctcgcgctcggtcaatatccgcttgacggccttcacgatgaacatgtcgatgccgctgagcctccatcctttgatcaggaaccaagcgccggtcggcgtcccttcagcaatctgctttccgtattgcagatatttttcaggccgaattctgaaacgtatcggctgatcaaccgagtcatcaacgcacatgatgtcgagaaactgcgactggcccttgtacaccgggtttttcccttgatcggccctcttcttctggcgaatcggttcgttctcatcggacagaactttcttcaccatcttgacgatgactaggccatcgtctccatcgcggatatcccgaatgttctgaatggggtttccggaagtcactccaaccagctccggattgtcataagcatgaccccagagcgtgtgagcttcgttcaagtctgcgaattgcacttcagaattcgacaaactagctgcgactttctcccaatcctgaagcgtcttcaggtgggtgcctgccagctctttatattgagccttcagctccttaagatcggccttcaactccttcagatcggccttcaacagtttctccagttctttgtcttggctgattttcgccgaaagaatctgggcttccagagctgctacatcagcagccttgtcctcaacatcctgtgccgatatcgggcaattggccagggcgatcctcgcggccttgacttcctcgcgaagacgcaggaaccgctcggccttcgccgggccgaagcctttggcgttcatgatgccgccgatcaggcgcccgtccgccaccacccagttgagttcggaatgctccgggtccagggccgtatattctacgccttctttggccaattcgcgaaggatggacacagtttgctggtcgtctttcgccgcccgaagacacgcggccgcgtattccaggcgatgatatcgcttcatgtagcaggtccagtacgtcaccacagcgtagctgaccgagtgggagcggttgaatccccaggcgccgaacgttaccatttcctgccaaacacggtgagcatcgtccggggcgacgcctatggtcttggcgccctcgatgaacaattcccggcgcttgttgaaaaattcttcgccctttcgcgcagacatggctttccgaatcgccgacgtttgttcccagtcgaactgcccaatgtccttcacaatggacatgatctgttcttggtacaggaaaactccatatgttccagacagatactgctcgacctgcgggatggtataggtcacaggctcgcgaccggccacgcgctcgatgtatttggtggccatgcccgaagacaacgggcctggacgggcgagcgccgttatgtggtcgatgttttcgaacgcggtgatattgatcgcattggcgaccgagcggacggcctggccttcgaactggaagatgccggacatcttgtcttcgttgagaatgtccagaaccgccttgtcgttcaacggcaagtcgtacagctcttgcgccgtcacgcaattagcatcttggatgacgcccagagttcgaagcccgagcgcatcgatcttgagaagattcagatattctgaatcgggcttgtcgagctgcgcgacaccttcagaagttaccgtgcagaagtcgatcacttcatcgttgcagaccaggatgcctgccgcgtggacgccggagtgggatgggtggatttcgaggtcgcccatgcaggcggacgcaatctcatacttttcacggaagtcgcggccgggctgagttttttcgaaagtatcctccaatccttttccatatcgttcgtccgccgatgtatattcgatgatcgagtttttgatgttgtcggtgtcgtggaatggaatgccgaagcgttttccgacgtgagcgataaccgacgcggccttgagtgtgttgatgttcccaagctttaccacgttccaagtgccgtatttctgctggagatattcgaacactaaatagcgatgggtatcggcaaagtcgatatctatatcgggaagatcggaacgggaaatgtcgataaagcgctggaagagaaggcgatgcgggagcgggtcaacctcggtaatgcccaggaggtagcagaccaaagagccggctgaagagccgcgagccgggccgaccagcatatgcttcttggcgaacgcaaccagatcggcgaccaccagaaagtagctgtcgaagtctttcagctgaatctgcttgatctcttcttggaatcgatcctcatactcctgggtccattccttgatgtggccgcgactgagacggtaggcttgcccctcgcgagccagcgcgacgatatccccatccaggtggatcataggcgccttcgccagtttcacatccgccaattgttcgactaccgcacgagtattggcggcggcggcatcgaactcttcgcgagtcatgatgtggcgtaaacggctccacaactcctcttcggtggcgatgtggcgaaggccgaccgattcccgcaccttccaggccgacgcgaaatcagcatggtcgatggacggcatgtcgttgtaagaggtaattaccaccggctttccgaatgccctggccgtctccatagcgccgtgcgcggcgaccatcgacgcgggattgatgtcaatgtagtcgattccggccagatccagatgggcataggcctcgccagcgaatttgatgacgccgtcagcttcctggaattcttgcggagtcaatccttgattctggaccgacttggaagtcaagcggtagaacttctttgtgtccttggcgagcacccaggctttgagcttcagctctttctcgccatcgtcggcgcatttgatcgggatttccatgccgaatccgcgaggcagttctgccttggtagcggcttgttcccaacggacgtggccccatgttccatcatcgacgatggcgacgaatggggattcgatctctttggcgcgctcgatgatctccgggaatcgaccatatgcggcgccgtaggagtaaccagagcgaacgcggagctgagggaaagacatcatgcggcctccattgcttgatacgcccgatacactcccatgcgcttgcagacttcgtggagcagccgcacgtcgtcgagcgcccggtgtttctgtacatatgggccgcagtagtgctcataaagatgttgcagccgcatgcggtggccgaacaacggcgccgactcttccacagtacagatatcgagcgatgggaaattgacttcgtccaggccgaacttgccgcgagccagatcgcaggccagcatgaacttatcgaatggcaggttgtgggcaatattcgcgtcggctctggaaaagaagtcgcgaactttctggcgctgatcgaggaaagatgggtgcttgatcaggtcttcgttcttcaacccggtgatcttggtgatgatttcctcgataacgattccaggattgcagatgaactctacttcatccaaaatcttttcgccatcagttatcacgccggcgaattcgattattctcggctgctttctcagactcaccctttggtggaacgggagtcctgtggtctcagtatcccatacagcgaatatcatgtttgttccctcttatgtcgaaaggccggctgctttcgcgaccggcctgaggagtataccgcgacggctgaagatttacgccttctgtccgtctttcggcgtgatgcggccggagcgcatggtggcgtgaacaaacgccgaatagttgatcgagtccaaggccgaatcggcatccttgaacccgctattcgccaggcgagtgagtttacccaccatgtgcatcacgaacagggcgagtcgatgatcatcggcggtcttcgccaccaggccgttcgggaagaggatttccatgatctttccgtacatcagatcattgcgaccataggtgctctggcgggcgcggaagacttctgctgcggcgtacagattgttgagaacatcttccgcgaaatcatcgggatgggaatcatcttcgcccggccagacggattccatggcgaacggcgcggcgtcttcggtcgggtctttgggctgagccgtttcagcgagcggagacggggctttcgcaaacgcctcgtcgagggtaggggcggagttcggggcggccgggaacggctcgcctgccatgtcgttgggcgcgctatcggggtcgctatcggccgcgacggcgaagaacggcgcatcgcaaccttccaggttcaggatgtaggagtcgatccccaggctattgtaggcatcgatgatgtcctggcgatcatcgaacgccgcgacgatcttggtgacgccttcgattttcttcaggatgtcgagcgcgactgcccgcttgaactgaggcgccggctcggtgttaccatacggccgcatgatgagttcatactcgcgatgttcggcgatgccgagttcgcggtggagcttggccctggtctggaaaaagtggttgtcggttcggccggtgacgaagaaaatcatgaggtcggcgtcgatggcattcctgatgcgacctacagcgtgcgggttgagagtgtccttgtcgagacgagaatgatactcgtcccattgccgttccaaggcgaagctcttgcggtggctatcgtcgaatacgcagccgtccagatcgaagatgatgatgccattcttgggtttgcgttccatattcagatttccttgatggttgctttctgggtgacggttttatcgatgaacgtcccatcagaagtgaggcggaaaacttcgccattctggctgaaatcgaacgattgcacgttcatcgtgatgcgaatggattcgctgccgttggtcacttcgacttgtgcgatgtcgccaactttctcgacaatgatcttcatgttacatggacttcccattaacggccacagggctggcctcttgtttttccgatccccagaaatcgcggcgcagttcttcctgctcggccgagcgatccatccatggacgatagaacttgcactgatagatcggtttcaccggcaactcaaccacaggaatctggccgggtttcgtctccagagcggacatgaagcggtcataggattgctcatgaatctcatcttcattcagaaccttcgatccatagcgcgggaaggcacaggagccagtagcgacacagtgcggctggagcagactatcgaacatcggatagacttccagaaccagtcggcgcatttcgcggaaggcttcctgatactccccttgcgtacgaacacacaggcgaactttcgccatgtcgctcagagtgcgcaaattgaacttggccgcgatcttcgtttccatgttggaaggaatgatggcacgagcatcctggagcgatgcgccggcctccaagagcttctggtaactggtctgcgcgtcggcgatggcatcgtgccacaggcggttcaactcttcgcgggcgtgataggtcgggtccggctcgccattggccgtagcctgctcatcgaaatcccagcggaatgcttccggctgaacaacggcgctaacctccagggcgcgactggtttcctgctggtaagcaccggtccgcgtccggacgagttggtgggtaaaattcttgcttacgccctcgatctggaaaatgaagtccacgaattcgaacggcgagcgaatggtgtccagcatgtacttccagtggtcgagcttttcggcttcggtcatggtcgccgggtcttggccgcgcatgcgggtggatttcgtccccaggaggagttcccaggcgttctgggtgtaactgatcagagaaatcttcatcagaaatcttccggaattggcgtgaaggtgaatttttctgtgagagcaagtgccaggccttgggcttgctccttacgaagtccatactgctccatctcttccttaagcagttcgcaggcctccagacgagactcatactcttcagcctcatgaactgacgagaagacggttccatcagaggttctgtatacgagttcaatagccatgatcgcctcagtagcagcggatgatttcggcgcggatatctcgacggtcgaggtagtgctcacgaatcttatcgcgggcgcgctcggcctcttctcgactgccgaacgacaggttgaacgaagtgaaaggcttatcgtccaggcgcccatcgccaatcaggtacaggatgcctaccagcacgaaagacggcgctgtctgtcgcgtttgcggcgggtcgatttgcatttctaggaaagacatgggaacctcttcaggatggtctggtgagtacatcaatagcgctcctgctgagcagctacggtttccggctcgtagatgagcatgtcaacgatttccgggcactggcctttcacccagtcgatggccgcgaccagtgtggtggaagcggagaaagagaaagtgcggtaagactcatggatgtacggcgaccccatcgaatcgcgctcggtcgtgcgagaaatgactgctttgatattaacgatccggcccatcttcggcctccactttagcgattatatctgacaggctcagcttctcgccattcaggaaataactggcgcgaaacttcctgtcaccctctggcccgacgatccgggccgttatggtgagactcccgccgccaagggcatcggtgtccctgaagaaagccagcagcgcccgcttgagcgctgcctcgcgaggatcgacggccattaacctaccacgttccagccgtgctgagcgcaccaaaccgcaccggcccctgcaggaaggctattcagaaggaatacaggggtcaggcggccatcctcggtcatgtggatgaagtagcgtgcactttcaccgagccattcggccttggcgatggcgcgttcaagattggccttggtggcgtaggtcttggtggtgtttttgtcggtggagaaggttacttcgcgggccattttgtcgattccttttggttgaagggtttcgcgtttcgatgagggaatactactctcacctgactcagaagtaaagcacttcgtgtcgattatttcacgaacatcttcttggccttctgataggacgaagaagtcatcaggcgctcgatgacatccatgtccgaaaccaggtcatccagaaggacgttgcgccaggtagcgaaccggccgagcgagaagatgccggcttcatgggtgaggttccagatcatggactcgcgctcgtcgcggccgagcggaacgattttgcctttggtctggatggtcggctcgccgtcctcgatgagatgccttttcctgatgccgaaggccgcgcaaacgtaatccatatcccagtcgctgtcccattcgatggtttcgattttaccatctaaagtctccactatccccttagtgatggattcgacgatcagagtatcaccggtgatggacgctcgaaacgttcccactttaggaccagggaaatacacggtctggaagacatcacaagggatggaaagcttgtatcgactcacgatgatggaggttccttcaccgaatgacgggtcgattcccaggtccagccctgccgcagccaggttggcgcggaatggcgcggtgctgatgacgttcacatggtcatcttgccggcgaagatactggaagaaagaggcgtcgaaaggacggctccaagtgatacgattcgcaagcttagccaccagctgctcatagtagtcggccggtgcgatccaacgcttttcagtcgccagattccagatggaccggtccgacaggccgcccgttactttcctggagtacatgttgcagtggtcgatgcgcggctgggaaatgaactcgccgtcgatgtagatagctttgtgtacagtgacttcgcggaacgggatgccggtgagttggccaatcactggcgagcggaatcgcagaagtgcgttgtggcgctccttattctccggcgtcgccgcgtcgatgatttgggcttgaggaaagcgatgcgcggcgatcagtccagcgagtccggcacctacgatgattactttctgatcaggaatcatgatatgttccttatgagtgtacaaaacttgagaggataaaaaagggacccattttcatgagtcccttgaagagctagacgattcaggctcagaggagcggcggcttactcctcctcaccttcggaaccatcggcgccctgatcttcaccgtcgtgctcctggccttcgtcatcggccttctcgtcatcgccctggccagcttcgtcttccttcgaagcgatggcaaccagatcgacccagcccatgatttccagcttgctcagatagctgcgaaccgaggtgccgtacagcaggtgggccaccttctcgccgaaggattcgatttcgaccggctcaccaacggtgcagtgctcgttgatgtaagcaaacaccttgccgcgagtcgagaaggcctgcggggttccatggccgtcgccggtcgggatgaagtgagtggcgcgggggcgacgcgagccgttggacttcaggtcttcgcggcgggcttcggccttcgcgcggcgctcttcctgctcttccttgcggcgctgcttctcggcttcgcgctctgccttcttctgctcggccaggcgcttgcgctcttcttcgcgtgcggctttctgggcttcctgcgcggccttcttctcttcggccttcttggcgcgctcggcttccttctcggccttcttctgctcgcgctcggcttccttggccttcgccttctcggcctgctcggcttccttcgccttggccttttcagcgcgctcggcttccttggcggcggccttttccttcgccttctcggcgcgctcggcttctttcttctcgcgctcggctttgcgcttctcttcgcgctcggctttcttctgctcggcttccttggccttggcttcggccttctcggcgcgctcgcgctctttacgttggcgctcagcggccttctcggccttgcgcagggcagcggcttgttccttggtcagctcttcgccttgggtctgttcgttctggtccttctgttccatgttcttactccgggaatgtttaaagggatggcttattggcctgtgaggggattatctctaaactaattgaagaagggaatacccttagcctgaactttcctaaatattttctttcgggaaagtccaaactctagggaacttatttatgttcgagaagttcctagcttttacgcaagaacagtaagtattcgattgcgcgagttatcccagtatacatcaactgactataagggatggacggcaagttttcttctaacatggcaacccgtttccattctgaaccctgcgacttgtggaacgtcatcgcccagccgaagtcgaatccgccaatagccttctgcgcctccagccgcacgtcttcctcggccgaaaagctcaaaggattgaacttcacccagcgctcatagttcgtgccgataatgcgaactttggcgaacaacatttcgtccggctcgtcatcatcctcttggccttcggggaccggcttgagttcgagcaggatggcttgctcgccgttcataatgccatattcgtgctggttcccggtgcaaaccagcttctcgccgatttccggttgtccacccttgtagccgaggatgcggcgcgccctggcgttcaaacggcggcgagtattgttgtaggcgcaaaggatcacgccatcatcgtccaagaacgtccgcatttcgtcgtccgacatgtcgaatccggcccgtaccagaatgtcgtcatactcgcggcagggtaggcgcttgccctggcggacgaacatcgacgcccgaacgatattgccggcgttgcgctcgatttcggtcatgatggtgtcacagctgttctcatggaaaatctggacgccgcgcacaggaggaacttggccaaagtcgccaatctccagaaccggaattcggtgcgacagcaagcgctcttcatcccactcgccgatcatggacgactcgtcgagcacgaccaacttcggcttctcgtcgagcgagtctttgttggcaaacatgatttcgccgtcttcatcttcgccaatcggccgatagatgaagctgtggagggtccgggcattggtgcaacccttctcgcgaagccgcgctgctgctttcccggttggcgcgacgaagaccgtccagtccatcgagcagcaaagttcggcgatgatcttcgcgatggaggtcttaccagttccggcgaaaccagcgagtcgatagacctggcggcggtgcgctcgatcacaccaaccgcgataccagtccacaacggaattgatcgcgtcgatctgctgactgtttggtcgaaagccgaatcgctcttcgatctgatcgacggtgaagttagatgctgacatatttgcgttctccaacgctaggtttaattgaatcgaggctcagtttaagcacgccgtccacagaccagccagtatcacgacgatacttgcggccttgcggatcgacatagaagttcttcgtgcgccgcagcagaacataatgccaagcagctccaagcgcgtggacccttcctttatacgggaaagccttcgcctgctctgcggcctctttggccccagggagccagcggacggtagaaaggaccaggaccgcacccttaatagcctgggaagcggcgcggccgtcctgtgggctatagcgatgtctatcgaagtctacccagtggtggttgccgcgccggagcttgaccgttcgggatcgcccctcgaacaccaccgtgccttcgtgagtaaaaatatgttccgccatcgaatgttcctttataacgtacagttatgctttacctctgcgcaggaagagtatactatcagctgactcgccaaagcgagcgaatttaatccaactttacttcggcaggaaagtggccgatactagcgccgccgcctgtactgccctccaaaacagaggatacattaaatgcaagaatgcaagatttcccgcgaccaactcccggtcggtaatccgaatcccaatgtcgacaagacccgcgacccgaacctgaagcccggtttcctgcgtcgcagccgcgagctggaaccggcgctggcagttcgcattcgtcgcgagctgatccacgccgaagcgtccgacttggccaaggccggatgggtcaattcacagtccagcctctatggatcgaaagccttcccgcgccattccgtcgttcgcgttaccggagttccggaagatggagctttcatcggcatgctgatcggcttcatcgagcatcgcgagcatggcgaatgggcggtcatggaagccggaacgaaagaaggcggcgcagtcatcatcccggtcaatcacatcacgcgagcgtcattcgccgaagccgaagagttcgccgaaaagtgggagcggaacttgggctggcgcctcctgcgacagctccgcgagtgcggcgccctggccgggactgaagacgagttcctgcggcggatcatcaatcgatacgttcgtgatcgcacgatcctcgatcaccacaaagtcggcgcggacaaaatctatactgatgcagtactcaaaagcatcggcgaaacatggccgaagattccttcggggaaattcgtcggacaccgagtcgcgcagctcctgatcggccacaagctaggtcgagcggggaccattctgaatgacctggtggacttcctggagaagttcgcggccgggcgcgataaaattctcaacatcgccatctgtaattgaggtgaatgaaatggttgacttggaaaagctgagtccaaagctgagtcctcggcagcatgccgttctactggagatgtacaggcatcctgagcatccagttcacagatcgccaacgaatttaactcttaaggctttgagacgaagggggcttgtcgagctatcctggaaggattccgtggctggatatatgttcggtcgccaaccttgctggaaaataactgatgccggcataaggcgaatcctgggagtgctggggaataatatggaaaaagaacaaagcgaagatcgcccaagcatccctgagtttgagaagaccgacgccaacaaactctatgatgctctggagacgatttcgctgctggagaagaagttggacgaatccgaaaagcgcgggagcgagctggccgcgagctattgtgacggcgtagtcggcgatgaatacggccatccttattgccgttataaagtggaacgcgacgccgccttggccgaagtagagcgcctgcgagaatcaaaaggcgatccctctggcagcttcgacaggtgtatgaagatgatgtacgagcgcgacgagaatgcaaaacgactcgacgccgccttggccagggtcgcggagctggaagggaagttgacggactgggtgcacgaagggttccggctcaacgaggcgctagcggtcgccaaggctcaacccagcgtgccggaaatatctggcatcggtcgcgatgccgaacatcccagagctgtagtgctgtatctgcgtaacgaacccagcgatgaagatatgcgagcaattcagaactttttgcgcgccatggccgcccccgctcagcacagcgtgccgaaagcatggctcgacgttcaggcagagcgccgccggcaggtcgaggcccaggcgctaaggcaggaagtcgcagcactgcgcgcaagggcggatgttgtgccggaggtattcgggcttgagcggtaccgcgtagaaaaaactgggaagggtttctggccatactgcgtgcgtgcgggggatggaacgcgtgaactgttcgtcggccacttgaagcagtgtcagcgggtagcgaccgaattggctacggcgtttgaagatgggaagtttatcgccgcgcccggcagctcggctcagcacagcgtgccggaggggtggaagctcgtaccgatggacccgacatcgcagatgacctatgtcggtcagtccctgcgttatgacgcggtaaacagcatcggcgagatttaccggcaaatgctcgccgtagctccctcacccatcgatccggccgcgcatcctcagccgtgccagcaaccacaggcccatcctgcccgctgcgggtgcgagcggtaagtgccaagtaaggaattcatgtaatggaacagaagaaaccttcaccagtagatggagtcatcatgaccagcctcgacgttctccggaaagcacagcccgaagcccaggacgagtatgccgtgtccatgttcgcaacggcgatccgccagaaaatgcagcgctcccgcgataaaggccgaggcggctggatcgactgcgacgaagatattctgatcaacggattcgccgaacatgcgctgaagggaaatgagaacaacctcttggacctggcgacgttcctgatgttcatgtgggtgcgcggcatcgacgatgcgaagattcccccggcgctcgaaaaggcgcggcagcacaagatcatggaagcatggagtcgggtccacgaagatggactaaactccgccagaaaggcgagtgctgcgcgacagttcgtggaagtgcctcgacgcaaggggcgcccggagcgacttgcatgaagcctcacgaaataagactggcacaggccgaagagttcctgcgcgaactcggccgagggattccggacgacgaacgggtgatggtcggctacgctgaagaggccacagtccaaaccgacgagaacggtcgcaagctcaacgccggctggtggcctgtgccctggaaggaagggaaatacatcaactcccgatccaacgcctacgcctgtatatcgtcgtccatcaagacgcccaacccgaagaccggccagatgcgatactggcgcggcgaagcctctttcggccacggcctagcgttgatggttgatgacatcggctccggcaaagggtcaaagggcgacttcgaccgcgacgagttccgcgagcgacttgagccgaccgcgattgtggagacttcgccgaacaactaccagttctggtatttcttcaaagagccgatgtcccacatgctccagttcaaggcgctgctctattcgttcgtggaccaggtgctaaagaaaggcggcgacaacaccgtcaaggacgtcagccgttacggccggatgcccttcggcttcaacaacaagcgcgggaaagacggcaagttcaaatatgccgacgaaaacggcaagcccgaactcgtgcgactgttcagcgccgactattccaagcgctactcgccagaagagatcgcccaggcattcggcgtccgcatcatcatgccacagatgaagaaggtggagataaaccgcgacgattgggtgtatgaccaagtatggctgaagtatgccgagcacatctgcacgaaatacaagatgggcgaagcggcaggcggccaggtccagcagaatatgtccggcaaataccgcatccgctgcccgtggggagacgagcacaccaacggcgatccattcggcgcctactttcgcggaccgatccctggagccgagcacgaatatgtgttcggctgcggccacgatacttgccgcaaagagcatcgccggacgtgggcggccttcacggatgaagtcgtgctaccctatatcgtcgaacaattggaaagaatcaaccgccgtcatatcggtgaggagtagacaatatgcaaaacgatcctggaatcctgattaccgccatcggcttgctgttcctcggccttatcatcttcttcgaaggcctaaagggatggaaaatacaagtcgcaaacttcctcgcgtcgcttctgtgcttcttcttcggcctttctgctttgacgttctggttcgtcgttgcgtttgacgtattttaatcgacgaacggtacagaaattttcggatggggacggaacttattagctatgccggtttaggtaggagataatagccgtccctttcgcctcaatgtgtagaggcaatgttgaatccgatcatgtaaagcagaaggcggcaaacctaacatgattatcgacgaagataatatttttgatgatggcgaatcagggtccagtgagtttgatctcacgcagatagaagatgctggaatggaccctttgatgaccgccgcgagcaaggcggccgatgatgcgattgcgaggaacgaaacgcatcgcgcgcaaaaggcggcaagatacgccgaggcgtatgctgaaccagacttgaggaagcgagcgcggttgttgatgctcgaccaggcgttcgatcttccggtcagccgggtggtgaaagggccgttcgatgacttcatcacgaaatacagctcgacgtcagacagcaactacctcgcggtctatgatacgttgttctgtaagggcgacggaaccgtcccacacccgcacttcgacgagtttcgcggccggctggtggaccatcgcggcgtggcgttcaacaacaagaccctcgatccgattgacctgatgggcgccctcgcggctgcggccttggacgatccctcgattaagaagacgattgagacttgctgcgtgtgggctcgtcgatatcgccgcaactctctgatcgagacgttcgagaagaagataccggagtgggatggtgaagagcgaatcgacacgctgctgatcgacttgttcaaaccgttcgacaccgaactcaaccggatggtgagcaagtatttctggctgagcttgtactgccgcatcaactaccctggaatctcggcgccgatctcgttggcgttgattggtgggcaggatgcggggaaatcatatttcggcttgctgatctgtaaggaactgtccggtgggcgcgatctggctccagttcagctcgacctgagccgacacgaccagacgccgttcctgcgcaacatcaccggcaactcggttattgcgaacgtcggcgaaatgtccggcttcaaaaagggcgacatggaacgcatcaaagaattcctggtgcgatcttcggatacattcgatcagaagtttgagcctggcgaaacgatcaagcgacaatggatcaccatcatggacggcaacggatacgatggactccagcgggacgactccggcaaccgtcgattctatccgatgttcgtggcacaacttcccgacgaagatggaaagccgaactgggttaagccgggcgatggtaatgaaccgttcaaggtggacttcacagacttcggccgcaagttctggcaggctatggctgagtgccgcgcctggatcgaagagcatggcgtcgatggatacctgaatatggtgtcggaagctaaccgcgaagtgcagaacttctctatttcggaaatggagaatgcgcgtggcgtggttcgtgatgatacgattgacatgtatctgatcaacgttctgataagttgcgagttcgaagagatcaagccgggcaagaattccaagaatcctgggtggagggctgacaccgtcaccattctgaaatggttcgatattctcgccaggaagaagccgatttctcgccacttaactccgcacctgaaggcgctggggttcgtcccgaacaagaacggcctggctggttggtgcctgcccgtcgataaggttgcgcctggatggacgaatagtatgcaaaccacgctgccgccgttcaatgatgcgcttgtgtacttgctgaggaagggcgacccggatatcactgatgaggctgcaatggcaaagattcgggcagtccgggccgagcgagccaagattttgggcgaggatttctgatgtagtggtggagtgtacttggattaggccgccttcgggcggtctttttctttggtgcggcgtacattagattccggcgttgggcgggattggtagaagtgaatacagtaatttggaccagtttcgagcgcgaataatggaaagtcgatagattttcggtatcggtttagcgtgtatggtggatggattttgcgtgaaatgttgagaaattgcgtgtttgaggtggacttttcgtgggaaatagccgcaaattactgtatagcgattctgagcggtaatttgggaagcctactgccgcgtgggttagcgggccaatttcctaatttccggtttttcgagcatgggttaaaactattctacagcgaaaat

SEQ ID NO: 3 - DNA, 43643 bp, Podoviridae Phikmvvirus
  misc_feature (1)..(43643)
tctaattttggtatcgtcgtgtgagaaccctcccgactctgatcagcccacccttcccccgtaggccctccgcctggtgggccactgcctcgcattgcctgggtgttgcctgggtcatccctgggagcttccagctacgctgggtggtggtgggcttccctgccctgtcgctgtcctgtcgccgcccattctacgcatcctggcgggagtgtcaacccctgggtggtcggtgccttgctcggctacgctccagcgcttccgcgtggtcggctaggcggttggctcgccagcgcttcgcccactctacacctcgctccacctcggaccacttgtccgccagcatcatgcgctgccatgccgcgtcctgctgtagccatgccctgctggctctgtcctgtctgctcagcatcctctgtctcctctgtctggctccctggggcttccctggggcgctgctgtggtcctgtcgggtgatggtgcgggagtggctggccttgcctcttgtgcctctgtacctgtggcattgccctggctctacctggctgctccctgggtattccctggggctgcctgggtggccctggccactccctctaggccacgtactctactcgcctccacctgtcctgtctagtcctgctctgctccctggagcttccctggatgctacctgggtgctggtctatctccctggctctgcctggcgctgtgctgtgctaccgctggtcctgctgtcttgcctcgccgctccctcgcctgctcggtcgcacctgcggcgctgatggactcctgtttgtccattgtgtgtgacataaccgcagccttagtgccatgcgggttccagggcgatgggtctggctggttggctgctccctgggtgggggctgtcgctccctggtaacgcaaatcctggctagctagactaagcctcgcgcatggggtctctatacgcgtgggaaggctccagggagcgcctggggaggggttgacacgttggcggtaggtctgtagagttcgccctgtcttcacgcaataccgccttcacaggcagcctggagacagggttgacacactacccgggcatcggtagagtacgcagccagaacgacgggagattgcaaccttccaagcgcggcacaagccataggcgcaagggacacggcaagctcttagggcaggaaccgcagtgtgtaaggccggcaggcatcactggggggattgacaaggtaatagatgcggtaagatgtgcggcgtcaagtggtcccgatgtacacactgtgaagggattacggcgcggtcagacagatgaccggcaccgcttgacactgtaaagctcagtcggtacgatgggcacccatagcggacgtgatggtccggggcgatgcggataggacgccttgtttataacctgaccgcaaagctgtgactccagccgataggactgacccaccacgtaaatacagacgggttgacacgacaaggccaagtcgataacatggccgccacaaagggaagcgatagcttcctggcggtagaggttcgaagcttcaccagcggtacatggactggtgcggtaggttgaccgaagctgcaactggttaggcagggtcccagggaatacctgtcgggtgctgaagactcacccaaaagagtctgagcgggaagcctccccgtccacggttaagcaaaggcacgttagtgccggtgggaacgaatagagtgtcagtgggatcgagaactagaaacctcggttaatcgcgactgacagtatgctgggtagtatcggtgggccgattgaacaaggccaggcagatagcgcaaagggtacgggggatgagtgaagacgatcccgaagagtatgcgcaggacaagccagaaccgctgatactacagggactatgccaatgccaaggtttgtcccttgaggcccttccaccgaggggattcaagagacagacctagttgaggaatgccgatggcacacttcaaggctaaggctcccaagtcgcccttcgctacccaggtagcgtactggcgggattgggaagccaaacgtactaagctcatcgcacaggataacgtcgaggggcgcaaagagcttcgcaagatgcgtgacgtgcgctacgctaccgacccggagccagcgccaggacgctaccataaccctgaacagaaagcgttcgtgaagggtagcgaaggcaaggcgcggaacatcctgaagggatggaacgctaagaagtcgcaagggaagggtttgtaatgccacgtgtgaatgaactgacgccgcgtcaacgcaaggccgccaaggctcgccgcgacaaggcacgccggattgatctagcgcacaagatgccgaaaggcgccgactgcccgatcttccgcaaggctgaacaggcgcaagctaagcagccccgcgtcgataccctgaccactccccgcagtgccggctacctggccgccgctgcttacctgaacaaatccatctgaggtacataccatgaccaacgcaatctccaaaaccgtaatcgcattccgtggcaccgaagagatcaatcgcgctatcgacgccatccgtgtccgtggcaaggaactcgacgaagccatccaactgaccggcctgtcgatcatccatcacatcgaccagtgtggtgacgtgaccgtggtcaaggcgctgtatgaagccatgccgaagggcagccgccgcaatgcgctggtcgagtggctggtgctgcacggcaaggtacaggtgaataccgacaagaagtcgaacaaggacctgcccttcctgtacaacaagttcggcaagaccgatctcgtaggcgccaccgacaacccgtggtacagcttcaagcctgagaaagcgctggaccaggagtttaacctggccgctgccctggccacgatcaaaaagcaggtgctccaggctcagaccaagggcaaggtgatcgtcggcatggaactgctgggtgatctggaagcgctggccgccaaggctgcacccatcgccgagcagagcaagcgcgctgccgcccattgactcaagtcgaacgcctgctaagcgggcgttccgctggaatcaatgacaactggagaaacacgatgagctttaagcaacgtctgcaacgtcaaatcgccctggcccaatacagccgcccggctcagttcccgtacggcgagcaggccgtccaggcgaagggagagtgaccatggacttctggattgccctccccttcctcgaactcggcctcaacctcggcgaggatgaactgcgcatgttgtggttcagcggcctgacggtattcttcatccacctcctgaagcggtgactcaagtcatggccctggcgggcgaccctcgcctactccggggccatcgctggactcatcacaagcgagaactaaaccatgcaagctttgaatactctgttgatcgcaatccccaaggacccgtcgaacgcattcaatgcagccgacaaggtgctgtgcgcccatggcttccgtatgggtgacctgaataccgcgcacgtgctgacccctggcgggttcgtagtagtgggcgccggcgtgaccgtcaaccgctacgacgaagcgtatcgtatgagccggaacctcgattccgaaggcttcgacgttctgctggtccagggcagtccactgtccgggcacgtcacctgccaggcgtacggctggatcaatgcggaataccgcaagggctgcgcgaacgggcgcccgatcttcgacattgcaggaacctcgtaccatgtcctcgcgtgatccctaccgtatcggccaccgcgtggggctggtgaactacagcgaccgctacctaggtgccgacgcggcaggcaccaagggcgtcattgaagccataacccgaccgtcccgctgtatgacgatctatcacgtacgctgtgagcggaccctgcgcttgatcgaggccgaggcccgtaacgtgcgattcatcagacagctaccgacccgcaaatgacgtggcgcataatcgtcgtcagcccatcaagcggctgcgccttcgtgtggagtctcaagcggcctgtgcggccagtgcgattctactcccgcaaggcagctaaacgctggctccgcaagcaccgccgacagggcttgcctggccactactacctcatcgtgaactggagcaaacgcctatgaatcctacttacgtcgtccgcctcaaggacggaaccacccgccaggtagtcgccgacagcatcgtcaccggccacgccttcgtcgaactctggttcctcggcggggcggtcgctatctacccggcctgcgaagtacaggaggtccaccgcactgacctcgtaaaggagggtggtgatgaatacccgcactgtatacgtcaagccgcacagttcgaggtgcccgccggtattgtccgcaggacgcctgaccccgggtgaactctaccacgtgatcgcacctgccgaggtcgaaggcgtcattgtgctggcaacttcaggcccgtggcacatccggtccgtggtggtgcatagcatgcacccctcggtatatcccgtagggatggctgtcactgacgattcctggcggttccgccgcctgggtgtgagcgagtacgtccaactaattcaagggtacgaacaatgatcgccatcctgttcgtactcggtctgtactgctgcctcggcctgctggcaggcgcctgctactgcatcgcagtggccccgccattcgagaacccgacggaagtgcagttccaggacgcatgcgtgatcgggtgcatctggccactcgtgatcctcgtcggcatattcctggcactccgtgcagtaggccggggcctgctgaccgggctgaagcgtcacctgaacatccaataacctaccggaggtaacatgatccgcacccatacccacaacaccgaccgcgaacagcgccgcatctacaagctcactgagctgacgtcgggtgagatgtacagtgtagtgcagcccgagtccaagcgtggcacgctggtggtcggagtagcaacctgggatagccagagccgacctgtagtgctgcccgtggtcattcacgatgtgggtgcgcatccctcgccctgtcccaccgtgctgcgcaacgacggctggcgcatggtgcttgccgccaagggcacccaggtaacactcaccgccgagtgaccaaggcgaaggctggtgcgccagccttccaccgtggccattccttgccgcgaaccaactcaaccgaggagctacaacatgaccaacgtcaacaccgccaccaccgagaccaccaccgctgctgccctgggcgccaagctcatcaagaagccggctaccgtggaagacttccgcaacaacgtggtcttccatcacaccgccctggccaagctgaccgaagtctacaacgaggcggtcgttgccctgcaaaccgccgagcgcctgtccagcctcgtcgccggtgacgtgatcaccttcgaccacggcaagggcgagaaagccgaagtgctgagcggcgaagtcatcagcgtggttgccggcgtttaccaggtgctggtccgcttcagcgacagcgcacctgccaagctgctggacgtgaaggccagcgccatccgcgccgtccagtcgtcggcagcccaggctgctaccctcgacgaagccatcgcccagggcgagtaaggcccgcacgtaataggcccggccctccgggcctattgcgagctagccataccataggaggagtcaccatgagcaagcgtaaccccgagcacatcagcggcgccgtgcgtagcgtcagcgtccagaagtcggcagccgtccaggaactggaggatcgtctggagtctgccctggccgtgtgccagcagcgggcggaagacatcgatctgctgagccgccgtctccaggccgccgagcgcgcccgccgctgggagatcgacgagattcgcaaccaccaggcgaccatccgcctgttgcagaacgacctgaacgctgcgcatgatgcccacgaggcacaagagcgccgcgctcgcaaggcaaccatcatggcctgggtatgcctgctgaccgcaggtttggccgtcaccctgaaactggcaggagtctgaccatgcagtgcaacgacctttacactaagctcgcagcgagcatgttcaacgtgccgtgctcccaggtgaccgccgagatgcgccgcgtagccaagagccgggcattcgcgtatgcttacactcccaagcgacaggcgtcgggtgggacgtacaccgcccgcgtgagcggcgtcacctgtgacggtggcaaggtggaggtacgtctggacaacgtggagcgcgccgacacctgtggctatgccaagctggaggcgctggaagcggtcagcctgtaccagggtgccgcgaagcgcgccgatgagtatgaaaagctactgctccaggcattcccggtggtggctaagcgtcgtgagcgcttgcgtatctccgggccgctgtcggcggaagacttccgggcaaacctgctcgggacgtgttccgcatatcggaatgccctcgacgccatacggggcgagattacctcgaccggcccgttgcggaaccgcatatgggcgctggtcgaacgtatgcaccgggccgagacgaagctcaggaatgctcagtcggagatcaaccgcctgcgggagcaggaactggaccgcctccgcaaggacatgtccagctactgcgccaacgacgttacctctacggtgagtgcagcatccgcgaaggataccctacgggtggcaaccttcgccgccgccctcgccggtggcgtcgtaggtagcgccctgatgttcctgctcagctagggcgaccagggcctactccggggtcaaatctgagggcgttcctagagcgccctctcgtgtgagtctggaggatcacgaacatgcaataccatttcacgcattacaacggataccgcttcggcgtcgagctggaagacgaggctgtcttcccgtgcatcgacggtaagcgggcgacctgggacaaggtggcggcgtgtgccggtagccttgtgcattacatggcgcaggacctgattgacttcggccagcgcaagttaagggagatcgaagatgagcaagacgagcctgtacccgctgagcctgcatcccggcctgattcaaatcaggacgattcacgtattcagcattcaagctccgagcaacgccgagaactggtggcaatggttcctctggcagcggaagtaccacccgctccgggagagcctgagtccagccggggaactgagtgcgagtatcgccgagtgtgtccaccgcctccgccagagtggctggcaagatagcgacatctggcgcaagaagggaggcgtgctggccctcggtgccttcgacctgtccggcctgatggtgggttcctgcctcgtagtaggcggtgagctgaaggccctgtgcgttgatgaccggcacagcaggcagggtatcggcgctgagctggtacgagctgccgagctggccggtgctgagcacctgacctgcttcgagttcctggagccgttctacgccggcttgggctggcgcaccgagcgccgtgaggcaaactggactgaaggcgagccggatgtgctgtacatgagggcacctggccatgacgcatgaggtgatggtatggcttatcgcgaacaaaccgctggtcatcggagtcgccttcagcctggtggccctgggcgtgctgctcacacagaacaacggcggcccgcctatggcgcccgcatgacctggcacctccaggacatgttcgaggcccgaggtgggctgaggcccttgtgggaggagtggtatcaatggcactgcgccgcgactcctggctaaagcaagcgcaatccctggcagtcggccaggcgggtcgattccgccacgtcctgggatgccagagcatgagccggggcgggaccaacatgacctgcaagaacctgcctgaccgctgggtggcatactgctactcctgtcaggaaggtggcgtggtcgagaaaacgcacgtgcggagggtgcaatgcgcggatcaagaacgcttcatgccctggcccgaggatgcctcggactggacgcaagccgactgctatcaatcgctatatggtttgctgctgtccaagggcatcgactacaacgtgatgacgccggggctgccgctgctctacagcgaaaggcagcatcggcttatcttccctaccgacgcgggctggattgggcgcgctactgccgaccaaaatcccaagtgggtgggctacgggtatcctgccccggactaccatggatggccccaggaatcatcaatgggcaggccatgggtgctgacggaagactacttgtcggcgctgaaggtgcggtgggcatgtcccgaagtcttcgctgtcggtctgaacggtacaaggctgcgcgacaggctggcggcgatcatgttgcagcagacctgcaagcgcgccttcatcttcttggatggcgaccgggcaggtgtccgtggtagtgcaggcgtgatgcgccggctccggtccctgcttatcgaaggccaagtcataccaacgccggacgggttcgaccccaaggacctgacccgcgagcagataaggagcctagtaattggacgtattgacgcttcacgcactgagtgaccgggaccgcttccgcacgttgcggagtgtggtgcccgaaggaatgatggggccggagacgtgcttcgtcatcgactggatcgagcagtattggaaggtctacccggtgcatcagaaggtagacccgcaggcactgcgcgaactgatcaagctgcgaggtggctaccagccagagcaactagcggtggtcctgaacctcgtcaaccaactggacaagccggtggacccggactcgctacagggcgttgtgtcccagctcaacgaactggatttctcagggcgggtggatgccctcctggcgcagtacaaccagggcgaggacatcgacctggcgtatgagctgcgccggctgagcgacgaggccctgcgccgcgagggggtcagcacgccgaccgactacgtgacggacgacgtgtttgatatcctcgcggaggagcagggtgaccacggcatcaagctgccggggctggtgctgccggcgtacatgaagggcctccacgccggggcctcggtgctggtggcggcgccgcctgatgcgggcaagacctcgttcatggcctggatcgctgtccatatcgcgccgcagctcaagcggtacttcgacccggggcggcccatcctgtggctgaacaacgagggcaagggtcggcggatcaagccgcgcctgtactcggcagccttgggcatgaccgtgggcgagattcttgccctggacccggaggaagttcgcaggatgtacgccgagaaaatcggcggcgactctgagctgatccgcatcaaggacttccacggtgggtcgctggctcaggctgaacaggtcatcgacgcgatgaagccagcggtggtgttttgggacatgatggcccacgtcaagggcggccagcgcaaggaccagaaccgtaccgacgagatggagtacaaggtggctgaggtccgcgagatggcggtacggcacgacttcatcagcttcatgacgtggcagattagcaacgacggccacgaccagttgttcccgccgcagtcctgcctcaaggattcgaagacagcggtacagggtgctgtggacgtgcaaatccacctgggccgtctcaacggcgcggatcaacaggtcatgcgtggcctgtccctgccgaagaacaagttccagatggacgggaagccttcgaacgtggaggcaatgattaacttcgacgccgcacggtgtcgtttctttgagagtgtggatcatgcaagctaagcatagccgggtgctcgaaggcaccaaagaaattccgctgggtagcatcgcactgttaccgggcaccgtcgcgggcctgctgctgtgcctgtactccgacgcaactcacgaggagggcgtcgccttggccggtgggttccctcgcgacttgctgcacggcgccactcccaaggacgtggatgttgccctgtacagcatgacctgggggcgggcagagcacctgatccagaaggcactcccggtcctgaaccccatcttcgtccgggatggtgggtggcgctcggactacgccgatggcggcgacggtggtatcttcaagggcgtgatgtccctcgtgggctgccgtgggttgaatggcatggacttggactttaactactacgacgccgacagcctcggtcgagtgatggagtcgttcgacttcaccatcaaccaggtaggcatcgcgtacaactggcccgaccccgaaggcggtccgcgcctgggtgcgtacctgcacaaggacgttacctggggcgtgaacagggaagtcggtaacggctcgcgactgccggagcgatgcgagaagatgcgggccaaggccgcgtattacggatgggagaacgtgtgatgagcaagcgcgacgtggtactggatatcgagaaaggcatctggcgcggcgtagaccagaacgacaaggccgtcgaggccatcatcaagaagcacgggtacgtgatcgtcgagcctaagatcgacgggtgccgtgccatcgtcggtgcgcatggcgtggtgtcccgaagcgggcgccgcttcccggccctggatagcttggaagaccgcatcatcgatcgactggcccgccccgggctggactccggcctggtgctggactgcgagatgtacctggccggcatgcccttcagcgaggcgactggccgcatgtcgcgcaagaccccactgaccgaggaagagctggggtgcctgcacttcgcggtgttcgacgccacccatatagacgtgctccgcaaggcgcgcacctcccacctggtatacgaagagcgccgcgccatggccagcagcctcctggcagcttgccgcctcagcgacactccgacgttcttccaggtaggctcgcaggtgtgtcggtcgatggaggaagtcttaggccggtactccctccaccgcgccatgggcttcgaagggtcgatggagaaagacccgagcatggtctaccgcaacggcaaggtcgccggctgctacaagcgcaagccggagatcaccgtagacgggcgcatcgtaggctacgtgccgggcaggaccggcaagaacgctggccgcatcgtgggctactatgtcgagttggaagacggctcgggcaccgtggccgccaccggtctgaccgaggagcacatcgagttcctgacccgtagccaatactactcgaccgtcaacgacacgatgccaaacttcggtcgcatcgtcgaggtctctgcgatggaacgctcggccaacaccctgcgccatcccagcttcagtcgcttccgcgaccttcccagcaatccaggagtcaaggtatgaagattcgaaagtcccgtaaccgcaactacccggaagatatggtgtaccacgccaccaaccgggattcactgctgtatccgaagtacgtcatgggttccgtgttcatcagccaggacggaacattccgcatctgcgtcatggcagggacctgggaccacgttgggtccgaagttctgcatcatgcacgggacatccaatcccttggcgccggtcgccgtaagttgcaccgggtcatgcgacggctgcgccgcaatctgcaacaggtaggagtcaaggtatgagaatgccaaccgaagaagaacgcacgatccgctgcctgctggcagatatccacgaacccttgaacctgctgttccccggtatccgtgtaaaggccgagacaatgcccttgggctggggagatagtatctgtgccctggtactccgggtgagctacgaacatcgcacgctgggtcgcctggagtacctgcacgaggtccccatcctgcacctgacgcagtggggccgggacggcatgctccagcacctgatgaacgagattccccgtcgggtgctggatggcatgctgcgccaggcacagaaatacagccagagcaactggtacagcaaatgacgactatccgaatcctcgacctcgaaaccgagagctacgagcacaaagggcgcaaagcgtcgccctttgacccccgcaactatatcgtcatggccggctggcgtgacgatgttgacggcaaggtcggccagaaggtggagcatcgcttccgcagccgggccgaagccgaagatccgaacaaccgctggttcaacctcgacggcgtggacgtgatcgtagcgcacaacgccatgttcgaatcgaactggttcttcacccgctaccgggacgagtacctggccttcctgcgacgtggtggccgggtctggtgtacccagcaggccgagtatctgctgagccatcagacgtggctgtacccggcactcgacgaactggccccgaagtacggcggcacccacaaggtggacggcatcaagctgctgtgggaccagggcgtgctcacctcggagatggaccaggacctgctgagcgagtacctgtccggcccgtgcggcgacatcgagaataccgccctcgtattctacggtcagttgatgaagctccaggcccgtggaatgtgggctggctacctggagcgctgcgaggccctgatcggtttctcggcgatggagtgcgccggcctgaaggtggacctcgaagtcgcccgggtgaaccacgccaagcaactggaagaggtggccgggatcgaggctgagctgaagaagctgatgcccgacttcccggaatacttcgagttcaagtataccagcctctaccatatgagcgcatggctctacggcggcgaggtgcggtacaagggccgggtgccctacgaagatggccggatggagaaagccgacttcgtgcgcttcggcacggccaagcgggggactcctatcgagagtacctcggtgcgggtcccgatccacgaagtgaccaaccagggtgagtggcactggcccaccatcaccgagctggcgaccaagcacggcccggtcatcacgttctccgccggcaagaacaagggcagcgtcaaggtgttccgtgaggatacggacatcccggcgaccaagtgggacgatgaccagcgattccgattccccgggctgatcaacctgaacaacctgccggaagtggtgcgcgagaaattcctaggcaagcgcccggagttccagtgcgccctcaccctggcggatggatcgcccgtgttcagcaccagcggcgacgccctccaggctctggagaaacagggcttcgaggcagccaagctgttgatgcgcctggccgagttgcacaaggacaactcctcgttctacatcacccacacctacaacaaggatgggacgatcaaggacacgaaggggatgcttcagtacgtggacgatgatggtatcatccaccactcgctgaatacgaccgcgacggccacgacccgactgtcgtccagccgcccgaacctccagcagctcccgtcaaaggacgaagacgacccggaagccggcagccgcgtgaaggagatgttcgtgtctcgcttcggcgcggacgggatgatcggcgagaccgactataccgccctggaggtggtgatgttggcggccctgtcgaaggaccggaacctcctggcgaagctgatggccggcacggacatgcacttgtaccgcctggcagggaagcacaacaactggaacgggttcgattacgaccagctcgtggccatcaagaaggaccccaaccatccgtggcacggtcgcatgatgcaggctcgaaagaacatcaagcccaaggcattctcggcgcagtacggtgcgagcgcggctggtatcgcattcaacaccggctgtaccgtggaagaggcccaggaattcctggacaacgaggcggccctgttccccgagtccatcgcattccggcagatcgtccgcgacagtgcagaggccaccagcctcgtgatgtacaaggccgaggaccagatgccggcgggcgccttcagcgagatggggtcggatggtaactggcgccagtaccgccgaggattctggcaagcgccgggaggcacctgctacagcttccgccaacaggaacgctgggacaaggaacagcgcaagacggtcatggacttcaaggacacgcagatcgccaactactggaaccagggcgaggctgggttcatgatgaccgtgagcgtggggcgcatcttccgttggatgctgcatcgcccgggattcatggtcaccgagttcctgatcaacaacgtacacgatgccgtgtacaccgactgccacaaggacaccgccgccgaggtcaacaagggcgtgcgcgacatcatggccgacgcggcccgctacatgagcgagcggctgggctacgacatcgccgacgttccattcccggcagtggctgagatggggccgaacatgttcaatatggaggtgatccagtgaaagaactgcatccgctgcacacgcccgagttcgtcaaaacattcctggaccagaccgggtgcctgcctggggtacgccgtacgggccgcaccaccggcattgctctacaggccatcggcatggcgctgtcccatccgagggaaaccctgacgttcgtggaccacccggacggcagctcggcagcactggtggccagcattgaaaccatactggcgaccctgggctaccggaacgtcctcgttcgacccacaacccgtgcggacgggcgcagcgtgaacatcgtcttcaagacgctgccgaacgcctgacgaccttccctactccggccttaaatcttccttcgacacaagagagaccacgtatgactcagcaactcaacgctctgcaagctgcactcgccctggccaacaaggctgccgagaccgcaaccatcgacatgtctgaaacctccaccggcggtggcggcggtcgaatcttcccggctggcaccgccatgggccgattctgcatctacatcgagctgggtgaccacgccaaggaattccagggcaagctcaagaacccggcgcctcaaatccgcctgggcttcgcactgtggggcgacgtgaacccgcaggccggtaatccgcagagccgcccggacgacctgttccacacctacgaggccgacggctcgatcaagcccggcctgttccgtaccttcgagatgaccctcggcaacaacgagaaatcgaagaccaagctcgccttcgacaagatgaactggagcgggcagcatacccacttcgctcagatgctcggccaggcgttcatcatcccgatcaagcgcaccaagatcaccaagggcaacaacgccggcaaggaacgcaacgacatcgattggggcggcatcatgaagccctacaatccggtcgatggcagcccgtacaacgtgccggaactgccgatggacctgttgcagtatttcttcttcgacgcgccgaccaaggagacctgggacgccctgcacatcgaaggcacctcggacaatggcaagtccaagaacttcctgcaagagaccattcgctcggccaccaacttccctggctcggccctgcacatcatgctgggcggcggcgacgatctgatcatcaagccgacgacccaggccgcaggcagcaacctgccggcagtgcccaacgtggccgccgatgcaggcgtagcagcagcccctgctgtcccggcagttccgcaggcagtgccgcagacggcccctagcgtgccccaggtggcgaatgtagctgcccctgtggtaggtactgccgaggcacagaacgtgctgcctgacgtaccgcaggtggctcaggtggcagctccggcggcggtcgaagtcccgtcggtcccggtagtgccggcagtaccgcaggtctaatgcgcctgccatcggaagagttcctggcaggactatccgcgcagttcgaccgcagcatggcaggcgggacgttggtgtgtgacgccgacggacccgcctacgtggctgcggccactgctaagaccttggacactgcactccggagattctggaagctcattttggagcagcagttcctagcgcactgcacggggacacgggttcacctcacggcagcaggtggggcgaaggcgtaccgggacacgtatccgaccatgaaaccctaccagggccagcgcaagggtaaggcaaagcccgcgctgctggagcctctgcgacgggccgtggcggacgtgcatgagcgcggcggcgcacccgaagggatcgatgtcatcctgcacacgttcttcgaggcggacgacggcatgatgatggacgcctacgccatgcaggacaaggccatcatccggtccgacgacaaagacctgcggatgacgatctacccgtattgggagatcgacacggcgtgtgtgagcaggatcgaaggcggcttcggctacctcaaggaggcatacacgccttccggccagttcaagctcaagggccacggacggaagttcttccttgcgcagtggctcggcggcgataccgctgacaacatccgagggatcgatcgattcaacgggaagctctgcgggatgaagacggccttcgatatcctccacccgatcacggacgaggatgaagccatcgacatgatcctggaggcgtacgccaagatcaagcaaaacccgctggcagaggccgaggtgctgtggatgcgccgaacgcctaccgacaacgcagcgcagtacctgttaagccgcgaccttcgtccggccttccgccagtggatcatcgagctggacgcctaccacgaggcgctgctccagaagcggagggagagtgactatgacgagtgagccgaaggtctaccagataccgcgcagccaacagcgcaccttcaccctgaagctgtgggccgagcagggcaagctatgcccgctctgcggtaagcccatcgatatcagcgtgaagggcgaggcggtgatggaccacgaccacgagacggggctggtgcggggcgtcctgcatcgatcctgtaacaccgcagaaggcaagatcacgaacgcggcgggttcctggggatgcaagtcgatgaagtacaccgacatcatcccctaccttcgtgccctcctgacgtacctggaggggccgaagcatccgctgatctaccccctgcacaagaccgacgaggagaaacacgaagcgaagctggccaagcgccggcaggcagccgccaaacgcaaggcggcgatggccgtcgcaaagcacaacgcgaggaacgtatgagcaaactccgcaagcaattcaccaatgagtacctgcgcaacgtctatgtcgagctgggtctcaagaagggcgccgagcatctgaccaggcattcgcgcttcggcgaagtgagccgccagtgcttccgcaactggtgcatcaagctgggcttccacgacagcaggacacgcggcacgtacgccaagaagggtgcgctgcactggctgggccgaaaggcggccgaggtagtgcgcaagttccctggcgccgtgggcaacgtggtcggccaagggccgaaggtgttgagcctggacatcgagacctcgcctatcgagggctgggtctggtcgctctggaagcagaacgtgggcctcaaccagatcaagcgggactggaccatcctgtcgttctgcgcgaagtggatgcacagcgacgaggtgatctacatggactgccagggcgaccccctggacgacatgcacctgctggtcgccctgcacaagctgttggacgaggccgacatcatcatcgtccagaacggcaagcgcttcgacgtgcccaagatcaacgcccggttcttcctgaacaagatgccgccgccacgaccgttcaaggtgatcgacaccttgatcatcgccaagcagcaattcgcgttcaccagccgcaagctggagtacatgacccacaaggcatgcaccatcaagaagcgcctccacggcaagttccccggattcgacctgtgggcagcctgcctccaggacaacccggaagcctgggaggagatgcgcctgtacaacatcgacgacgtacgatcgatggaggagctgtacatcctgatgcgcccgtggttcgtcggccatcccaacgtggccgtgtacttcaacgacgctgagccgactatccgatgcccgaagtgtggcgacacggatgtcaagcaagaaggctgggtgcatacgcagaccggcaagtacgagcactatcactgcggtggctgtggtggctggagccgagggcggtatacccgcaacacctcggaacagcgcaaggccctgctgagcaactaaggaggctatatgagcctggcgttctccgatccctacgaatctacgggcacccagcccggccagtaccgcaaaggcgcggccccggacgagcgaaaggccggcaagctcccgatgcacctggtggttgaaggcttcccgctgctaaagcgggagcttgcccgcatgatgcagtgggccgccgaggtcaagggctacaagccccacgactggaagaagatgtcggtgggcgagttcaaggccgcccaacaccggcacgaatcccaccgcctgctggacgggccgctggatgacgagtcgaacctgatgcacctcgtgcatgaggcattcaacgcaatggccgccgccgagcgtgccttgatggaccgggagaaaggcaatgagtaaaatctgttggtgtacccgaccgcacgagaccgacgaaggtgtacgtgtcatctgggccttcaacgagcggggcatcggggtaaactacgtcacggcgtacgtcacgccggcgatgatccaccacccggactggcgcgataccatcctcccggacatcctccaggagatggcggagcgcctggaccgcgaggttaagctggtggaattgcgctggttccgcgctgagattctgagctgcggggaatggcgtgactaccgagcaatgacgctggacggggcggtcagcctggccgaggccgagtggggtcccgaggatatcgggcgcgtaatcgaaagacgataggagacggaatggacctgatacagcagcagatcgcccacgaagaggcccttgtcggggcggcgcagaacgacgcccgcattgccttggaaaaggcgatagcccaagggtccatcgaccgcatcccgagggcacgcatcatgttgatgcggatgctccccatcgtgaccgaagcgatcttcgcccaccaggaagcgaaggcggcgggaccggcagcgaagctgcgacacctgctgcggatcatcgacgcccaggacctcgcggtcatggcgctacgggccgggctgtcgatgctcatcaactacccaacgatcaccgcgacgaagtattacacccatatgggcaagatgctctgccgcgagatcgaagtgcggttggccttcaaggtcaaccaaccctattacgaccggacgctggactacctcaagaccagcaggactcgcagcgtccggcacatccagaagacgatggacgcccttctggacgcggtactgcccgaggaggcacgtatcgacctgccggatggcgactacctgcgtctcggcaagttcatcggtgacccgctgatccaatgcggcctgttcgagccgaaccgcttcacaggccggggcggtacgagcgtccacctggagccgtcgccggaggccaaggagttcctgcaagacccgtcggcggcgatgacctggggaggcccaggccgtagcgtaatgctggcaccaccgagaccctggaacgactggtgcgatggcgggtactacagcgccaaggcgcagaagcatcacgtattggtgcgtcgtaccaaacaccagaccaagcgggcacgtcagatgcagctccgccacctgggccgggacaagatgcccaaggtatacgcggcggtcaacgcactgcaatcggtggcctacgagatcaaccacgacgtgtacgagatcatcgagcgcatcttcacttccggcggcggcgtgctgggtatcccgcagcgtacctacccggacaaacctgagttcccgctcggcgacgagtgggccaaggagaacgccagtgaacaagagctggaagccttcaaccgatggaagcgatccgtccaccgatggtacaccggggagcgggagcataccgccaagcttcgcgaatttgctgcactctaccgagttgttcgagagcatcatggcaaggcagtgtacttcccgatgcacgttgactcccgtggccgcatgtactattggggcacaccgaatccccaagggtccgacatcgccaaggcatgccttcagttccacgaaaagcgcgccctcggcaagcgcggcctgtactggctcaaggtccacgtcgccaactccctcggatgtgacaaggtgtacttcgacgaccgggcagcctgggtcgatgagcgatgggacgacttccagcgagcactcgacgaaggcccggagaactatccgaatctcttccccgaagacgagtcgcccctgtgcgccatcgccggtctgctggagctgcgggcggcctacgcatcaggccagccggagaattaccgaagtgggttcatcgtccatatggatgcaacctgctccggcctccagcactactcagccatcctccgagacgagatcggcggagcatacgtcaacctgttgccacctggacttgccaaagctgacatctactcccgagttctcggtctcgttgcagagtctctggcacgagacatcgagagtgctgaaggcgaggctcggggctacgctgtactgtgggataaggccggtcttgccaggagcctgacgaagaaaccctgcatgacgctggtgtacggaaccacgttcaagggtgttgtggaccactgcctggactacctggacgagtccggcctggagattcccgagggtatcccgtcataccgcctgggaagctacatggcaacgctcatactggacgcaattcgcgagacagtaccatcggcagtcttcgccatggaatggctccagcggctcgctaaggcccttcctgacgcatccaaggatttgcactggaccacgccactcggcatgcaggtcttccagtcctacccgaagaccgaggaggtccgggtgcggctgcgggccgaggctgtcgagtacgtcaccctgtacgaggccaaggacgagctggacccggtacgcaacgccaacggcatcgccccgaacttcgtccacgggctggatagcagccacctgggcctgacagccctggcatgcgcggcggagggaatcccgatccaggccatccacgacagcatgggcacctatgcggcagacgtggatcggatgcacgtccacatacgggagcagttcatcgccatgtacagtggcccctgtgtgctcgtagagctggcaaatcagcttggggtagaggctaccccgccccggaggggatcgttgaatctggaggctgtacgggactcctgggcgttcttctgctgaggtggattatgtcacccacataggagcaagtgcatccgtccaaggccctcgtagagggagcggggagagaggagaggtcagggaagacctggtagaggagaggtggagatgagaatggatgactacgaaggattctagatagaatagactaaccagcataggagatatgatagatggctactatgaagacccaccgccctacggttatgtcacccacagtggaaggatcgagaacaggcaagggtacggcccgtcctgtcacgttcacctctcagcagatcgagtggttagaacagaccttccccgaacatcagatcggtcctggaaccacgatggaagacatccagttccaggccggcaggcgagacgttgtgcgagcagtacgactgcgccgacgtgatgccatcgcagtggagctgaagtgatgagtaagtccatctggcgagtacacgcaaaggccggcactccctcggaactccagggcctgtgctggctggcaatacaggagctggaggagttcaccctcttccgctcgaaggacgacgccctgaatgcgatgctggacagtatcgagggcaacgatcgaaccgagctgttggtattccgcgatggtcagttggccggcggtgcctgcatcgtgttcgaggacgacccccacgtcggcccgtgcgtcacagcacagtggcagtacgtcctaccgcgctaccgcaatacaggcgtggtccgggagttcatccgcgaactccaccgtcaggccggctggggtcaaatccccctcgtgtgctggagccatcgtgaaagcgatagccggtacacgatccactaccggagagccaagccttatgggcaagaaagtcaagaaggtgctaggcaagaccatcatcggcaaactcgctgatggcctgctgggcaccgaccttagcggcgcacaatccgatgcccgcaagatggaagagcagaaccgcctaatgcagcagcaggcggaccagctcgcacgaaaccagcaggttgacctcaccgccgagaacgtggcgcaggttgacctaggagcgatggccgatgccactggcaccggcactcgacgacgccggaatcaggcgggcacaggcgtatcgcaaaccctcggtatcaactactgacgaggtacgccatgaaaaccaccgcagctatgctgtgggagaaacttcgggatgggagcgtggagagtcgagccatcgagttcgccaagaccacgctgccctacctgatggtcgatcccatgtccggcagtcggggagtcgtagagcatgacttccagtccgccggcgccctcctggtgaacaacctcgccgccaagctggcgagatcgctgttccccacggggattccgttcttccgatccgaactcactgatgcgatccgccgcgaggccgacagccgggacacagacattaccgaagtgaccgctgccttggctcgggtggatcgcaaagcaacacagcgcctgttccagaacgcctccctggcggtcctgacgcaggtgatcaagctactgatcgtgactggcaatgctctgctgtaccgagacagcgccgccgctacggtggtcgcatggtcgctccgctcttacgcggtgcgccgggatgcgactggccgctggatggatatcgtcctcaagcagcgctacaagtccaaggacctggatgaagagtacaagcaggacctgatgcgcgcaggccgcaacctgtccggttcgggcagcgtggacctgtacacccacgtacagcgcaagaagggcacggcgatggaatacgccgagctgtaccacgagatcgacggcgtgcgtgtgggcaaggagggccgctggcctatccacctgtgcccgtacatcgtgccgacctggaacctcgcccctggcgagcactacggtcgcggccacgtcgaggactacatcggcgacttcgccaagctgtccctgctgagtgagaaactcggcctgtacgagctggagtcgctggaggtcctgaacctcgtggacgaggccaagggtgcggtagtcgatgactaccaagacgccgagatgggcgattacgtgccaggcggtgcggaagccgtccgtgcttacgagcgtggcgactacaacaagatggctgctatccagcagagcttgcaagccgtggtcgtccgcctgaaccaggcgttcatgtacggtgccaaccagcgcgacgccgagcgcgtcactgccgaggaagtccgcatcactgcggaggaggcggagaacacgctgggcggtacttactcgctcctggccgagaaccttcagtcgccgctggcgtacgtctgcctgtccgaggtggacgatgcgctcctccagggcttgatcaccaagcagcacaagccggctatcgagacgggccttcccgccctgtcccgctccgccgctgtgcagagcatgctcaacgcttcccaggtcatcgctggcctggccccgattgctcagctcgatccccgcatctcgctaccgaagatgatggatacgatttgggcagccttcagtgtcgatacctcgcagttctacaagagcgaggcggagctacaggccgaggcagaacagcagcgccagcaggccgcacaggcccaggcagcgcaggaaaccttgctggaaggcgcttccgacatgaccaacgcactcgcaggagtctgatagatgacccaaccgaacgaacagcaactgccgccgggcctcgctaacctggttgccaacgtaccgcctgccgccgcaccgaccccgagtcatgtgcaggtgatgccgaacccggtgatccaaccgcaggccccggtccagcccggccaggtaggtgcgccgcagcaactggccatcccgacccagcagccgcaacccgttccgaccagcgccatgacgccgcactaccaaccggtagcggcacctgccgtgggtcaacccgttgttccgcaagcacccgctcagccggccccggtagctccgccggctgcgggtgcagttcttcccgagaacctggaagtcccgccgccgccggccttcactcccaacggggagatcgtgggcaccttggcagggaacctcgaaggcgacccgcagttggcgccctccatcagctatctggaggcgttctctgacaaactggataccgtccgagccttcggcaaggccgccgagaaccgcgatcctcggttcatcgacgagcactatctgaaggaagttctcggcccggcccaggcgcagcacgtcatcaacgtggccaagggcgtcctgacctatgtcgatgcgcaaaccaaggctgtcctgaaccagacctatgccgccgtcggtggcgaggccgtgctgaagcaggccgcaggcgtcttcaaccaacacgctgacccggccaccaaggccgccatcggtcggctgatggactctggcgatgcccaggccatgcagtacgcagcgaagcagatcattgccttcgcacaaggctccggtgccgttgtacaggctaccggccaacccctgggtgctgcggcacctgcactagcagccctgaccgctgagcagtaccgcgcagaagtgtcgaagctgccgctgaacgcatccgaagccgacatggctgcactgcgagagcgccgtaaggcaggcatggcgcagggtatctaacgaccctgccctactccggccttaaactcacatccaaaagagagagaatcgcatgagctttctgaacgacctgacccgtccgaactacgctggcaaggacgcggacgttgacatccacctggaagagcacctcggcatcgtcgacaagcacttcgcctacacctccaagttcgcaccgctgatgaacatccgcgacctgcgtggctcgaacgtggtccgcctggatcgcctgggtaacgtcaaggtcaagggtcgtcgcgccggtgaagagctggagcgcagccgagtcgtgaacgacaagtggaacctgaccgttgacaccctgctgtacctccgccaccagttcgaccaccaggacgagtggacccaatccttcgacatgcgcaaggaagtcgccgagctggacggccaggaactggctcgcaagttcgaccaagcctgcctgatccaggtgatcaaggctgccgcgatggacgcaccggtggacctggaagacgccttctcgccgggcgtgctggagaagctggacctgaccggcctgaccgccaagcaggctgccgagaagatcgtccgcatgcaccgccgcgtagtcgagaccttcatcgaccgcgacctgggcgatgcggtctactccgagggcctgaccccgatgtcgccacgtgtgttcagcctgctgctggaacacgacaagctgatgaacgtcgagtaccaggcaaccggcgcgaccaacgattacgtgaagtcgcgtgtggccgtcctcaacggcgtcaaggtgctggagactccgcgcttcgccaccgacgcaaacgcagcgcatccgctgggccgccacttcaacgtgagcgccgaggaggctgagcgtcagatcgccctgttcctcccgagcaagaccctgatcaccgcccaggtggcgccggttcaggccaagctgtgggaagaccacgataagttctcgtgggttctggataccttccagatgtacaacatcggtgcccgtcgcccggacaccgctggtgccatcgagctgaagggtatcggcgccttcgacatcaccgcgtgatgccacgaaaccccgcacttcggtgtggggtttcttcaaagcctaacgacccgcgcagattccctgcgtgggtttttgcgctttaggagaaaccctatgctactactcgacgcagtgaatgtcatcctgcgcaagatcggcgagctgccgatcccgagcatggatgagacgtatcccaccatggccattgccctccctgagctggaggaccagcgcatccagttgctgacgcaaggctggtggttcaacacctggtggaagcacaagctgacacctgatcccacgggccgcatcaacctgcccaagggcaccttggcattctacccggattccccggacctccagtgggacggcctgggagtgcgcgacgccaacaccggcgacgaccgcatcggtaagtcggtcgagggccggctggtgctgtcccgcgagtgggaccgtatccccgagatcgcacagcgcgtcattgcgcaccaggccgcactcgcggtgtacacccacgagattggcccggacgagaccgcccaggtcatcgcccaggaattgcaggcgtatcagaacgaactgtcccgcatgcacacccgatcccgtccgctgaacacccaggccaagcgtagcttcagccggtggcggcgcagcttgaggacctgagcatgagctacaagcaatccgcgtatcccaatctgctgatgggtgtgagccagcaggtgcccttcgagcgcctacctggccagctcagcgagcagatcaacatggtatcagaccccgtgtcggggctgcggcggcgcagcggtatcgagctgatggcccacctgcataccgaccaaccctggccgaggccgttcctctaccacacgaaccttggtggccgcagcattgcgatgctggtggcgcagcaccgtggcgagctgtacctgttcgacgagcgggacggtcgcctgctgatgggtcagcccctggtgcatgactacctcaaggccaacgattacaggcagctacgggccgccacggtggccgatgacctattcatcgccaacctgagcgtgaagcccgaggccgaccgcaccgacatcaagggcgtggaccccaacaaggccggctggctgtacatcaaggcgggccagtattcgaaggcattctccatgaccatcaaggtcaaggacaacgccaccggcaccacctacagccacacggctacctacgtgacgccggacaacgccagcacgaaccccaaccttgcggaagcgcccttccaaacgagcgtaggctacatcgcctggcagctctacggcaagttcttcggtgcgccagagtacaccctgccgaactccacgaagaaatacccgaaggttaaccaggatgccgatgcggcaaccatagccggatacctcaaccagcgtggggtgcaggacgggtacatcgcattccggggagatgccgacatcaacgtcgaagtgtccacggacatgggcaacaactacggcatcgcgtcgggcggtatgagcctcaacgcaacggcggacctgccggccttgctgcctggtgcgggcgcacccggtgtgggtgttcagttcatggatggtgccgtcatggccaccggctcgaccaaggccccggtgtacttcgagtgggactccgctaaccgccgatgggcagagcgggccgcctacgggaccgattgggtcctgaagaagatgcccttggcgctacgctgggatgaggctaccgacacctacagcttgaacgagctggactatgatcggcgcggctccggcgacgaggacacgaaccccacgttcaacttcgtcacccgaggcatcaccggcatgacgaccttccagggtcgcctcgttctcctgtcgcaggagtacgtctgcatgtcagccagcaacaatccgcaccgctggttcaagaagtcggcagccgcgctgaacgacgacgatcctatcgagatcgccgctcagggcagcctgaccgagccgtacgagcatgcggtcaccttcaacaaggacttgatcgtcttcgccaagaagtatcaggccgtggtcccgggtggcggcatcgtgaccccgcgaacagcagtcatcagcatcaccacgcagtacgacctcgatacccgggcggcacctgctgtgactggacgcagcgtgtacttcgctgccgagcgtgccctgggtttcatgggcctgcacgagatggccccgtcgccgtccacggacagccactacgtcgccgaggacgttaccagccacatcccgagctacatgccggggccggctgagtacatccaggcggcggcctccagcggctacctggtgtttggcaccagcacggcggacgagatgatctgccaccagtacctctggcagggcaacgagaaagtccagaacgccttccaccgatggacgctgcggcatcagatcatcggcgcgtacttcaccggcgacaacctgatggtcctaatccagaagggccaggagatcgccttgggccggatgcacctgaatagcctgccagcccgcgagggtctgcaatatccgaagtacgactactggcggcgtatcgaggcgaccgtcgatggtgagctggagctgaccaagcagcactgggacctgatcaaggatgcctctgccgtataccagctccagcccgtggccggtgcctacatggaacgtacccatctcggcgtgaagcgcgagacgaatacgaaggtgttcctcgacgtgcccgaggccgtggtcgggtcggtgtacgtggtcggctgtgagttctggtccaaggtggagttcactccgccagtgctccgagaccacaatggcctgcccatgacctcgacccgcgcagtgcttcatcggtacaacgtaaacttcggctggaccggcgagttcctgtggcgcatcagcgacacagcccgacccaatcagccgtggtacgacacgacgcctctgcggttgttcagtcggcagctcaacgccggggaacctctggtggacagcgccgtggtgccgctgccggctcgggtcgatatggctacgtccaagttcgagttgagctgccatagtccgtacgacatgaacgtccgggctgtcgagtacaacttcaagtccaaccaaatctacaggagggtgtgatggctttctggctaccactattggccgctggcggcatgtccgcccttcagcagggattggccaacaaggaagagcgcaacaagatcaaggccgagaacaaggctcgactgaagacggacctcgacaacctgggcgccgccgcccgcgacatcgccaacctcggagtcatggccgctagctaccgcaagcaggccgtggcctcgcaggtggaggccaaacgccaggggatgctcgccggcggcagtgccgaggctcaggccggagcgttcggcgtcaagggcgcatccgttgatgcggtggccctggatatcgagcgggaggtcggcgaggctctgttccagattgacgacaacctggacaatcagatgtggaacctcgccgagcaggcgcactccatccaggcccaagctaaggccggcctgctgggacagaagagcaccactgcggggcaacgatccccgctggtggctggcctgatgtcggcgggttccctgtatgcaagtcaatacttcaagttcggcgccacgcctaaaggaggcaactgatggcggaatcgcaacgtgcttcccaagagcttgggatcaacgtcgggcagacgcaactccagccgggccagagtgcccggcgtggggtgcgcgactccgaagtcaactacagcgggccgagtgtaggctcacagattctcgacggcatcctcggcgccggtcagcaaatcgcaggcaagtggttcgagcacaacgtgcagcaggaagtgctgcgcggtgagcgtgcccgcatggccggcgaggccgaggaggcggtagacagcaacatcctggccaagcccttcgtgaagggcggctggcgtaagcaggactaccgtatcgctcaggcggacttcagcctgaagatgcagcagttcatcgccaacaagggccgggagatgactcccgaggagttccgcaaatacctgtcccaggaggctacgcacgtcctggactcgacaaagggcatgaaccccaacgacgccctacaggcgctggcgcagcagcagaaggccgaggagcagctcttcggcatgcaggccaaggcgtacatggactggtccatcgaccaggccgcacgaggcttccgcacccagggtaacagcatcctggccaaggctgtacaggcccaggccaccggcgacgaactgtcccgacaactcagcctggaagaggctggcctgttctataccaacatcatgacctccgaggatatcccgctggaggtgcgtgacaaggtgggcatgcagttcctggcagccagcctggacatgaaccagcggggcatctacgagagtctgcgcgatgccggcttcctggacagcatgtccttcgacgaccggcgtgcgctcaacggcctctatgaaaagtcgaaggcacagacccgggccaaggaatcgatggctaccctgcgggccgatgcggacttccagcagcgggtggctaacggggccatcacagaccttgccgaggtcgaggcgtactcccggggcatggtcgaggagggccgctggagcgacgcccaggccatctcgttcatgaccaaggccatgaccggcctgggcaacgctcagcgcatgcagggcatcatggcggccctggaggctggggacatcaacgccctgcacacgctggggacgaacgtctccgaggcactggagcagtgggacaagatgcaggcggccaacggctcaagcctgaccgatcgactcgtacagggcacgcagctcggcctgcgcctggggaccttccccaagacctacggcgagtccgtgggcagcgccgtgcggatgatccaggcggccaaggaaggcgaggcgaacccggagctggtcaatacgttgaacagcatcttcgagcaggtggcctcggcccaggagatcaacccctccgccggcaacgtgatgctatccggcatcccggaagccgagcagggcgctgtggcctgggcactcaagcagatgaagatgggcatcgccccagctcaagcactgcgcgagttcagtgccaacgccgaagtcgtgaagcagatggacgagttcgagaaaggacagaacaccaaggcattcaaggacaacctcggcaagcaggtcaacgacaagttcgtgaacaacatcttcggtcgggcctggaacatgctgaccggtgagagcgacctgagcaacaacgaggccgttctcagcatgtaccgtcgagcaaccatcgacgaggcgaactggctggccagcgaccgcaagcatgcgggtctgcttaccagtgacacgggccgcgaggccctgctggagatcgccgccgccaacgtgcgtaaccgcaccatccaggtaggcgaaggtcggaacctgaaggaaggggacctgttcagccgccgcgacagcgcgccactgatcctaccccgtggaaccaccgccgagcagctattcgggaccaacgataccgagaccatcgggaccgtcctggccgagcagcacaagccgcatgtcgaaggactcctcggttacaagtcggtagtcgccttcgagtacgaccgcaccagtggcagcctcctcgccgtcgagtacgatgagaacggtgtggccctggaccgcacgcgggtcgatccccaggcagtcggtaacgaggtgctcaagcgcaactcggacaagctgaacgcgatgcgaggtgccgagtacggtgccaacgtcaaggtcagcggcacggacattcgcatgaacggtggcaacagtgccggcatgctgaagcaggacgtgttcaactggcggaaggaactggctcagttcgaggcttaccgaggggaggcgtacaaggatgccgatggttatagtgtgggcctggggcattacctgggcagtggcaatgctggggcaggtactacagtcacgcctgagcaggccgcgcagtggttcgccgaagacaccgaccgcgcactcgaccagggtgtgaggttggccgacgagctgggcgttacgaacaatgcctctatcctgggcttggccggtatggccttccagatgggcgaggggcgtgcccggcagttccgtaacaccttccaggcgatcaaggatcgtaacaaggaagccttcgaggctggcgtacggaacagcaaatggtacacgcagacgcccaaccgggctgaggcattcatcaagcgcatggcgccccacttcgatacaccgagccaaatcggggtcgattggtacagcgccgcaacagcggagtaagacatggcacagcaattcaagggccgcatgacgcccaagtacccacttgaccaagcacagctcgacgaggcccaagtacagggccaactcgacgcagtgcctaccgtggggttcgacgccctgacgggtggcgagatcggagaacggaacgtggcagcgggccaacgagccaacgcgcgggaactggaacgcatcgtagcggaccaggaactgccggcccttgaccgtgcttccgcactctggaaccagtccaccctcgtcggacgctggggcgatgcgctccagctcgacgcggaccttgcggcgaacagcaccggcgaggtggaccccaacttcgacgccgggacctacggggtccaggcgctccaggcggcgggtatccagccgactgacaactatctccagatcatggcccgtgccggcaatgccgaggacgcggcctacctcctgtcgaggattcaacggtatgagcaggacgagcaaatcgtgcgggacaacccgtactggaacttcgcggctggcatgctggaccccgccgctctggcagttgatgcggttactttcggcgctggccgtgctctgcggctcggtcgtgctggcatggctgctgctggcggcgctgggcaagtcgggtatgttgctgggctggatgccgcaggggccgacgtggatgccggaacctacatcgtggcaggtgctcttggcgctggcgtgggtgctctgctggggtctggtgcgggacgcattgccgcagaggccccaacgcaaccgcatgtgcccgaagtatcggcgcctactgtcgggctgccagaagtagccatgaccgccgaggaggccgccgcacgcggcttcaaggccggtgacgtggtagacctgctggacgagggcaccgtgctgtcccgtgtcagctcccgtgtggagcaggccgagataccggccatcccgcgccgtgacactgccttcggcgacgagctgcacagcctgtcgggccggaagctgtccgaggtcctggaccacctcaagacccacgcagaggttcccaagccgctccagggcatcgccgccaaggtggctgataccatcaggaccctggagggcctgggccagcgaaccgcgttccgagtggtgcagggtggcgacactgccagctccgcattccttaagccgggcacggcgggcatccactccacccagggcctcgacaccttggtccaggtacgcggcagcaccgcacctggtcgagttggcaccaacccggtgaccgtgctccacgaggcggtccacgctgccaccgtaggcgtgatgaacgccgccctgcgcaaccctggcgcgatgagtccgaaggtggctcaggccatgcagaccctggagaacgtccggggtaacgtgctcaacgccctgaagcaggaccgcgccgccggtcggcaactgtccgagttcgaagagacgctgctggccggcaactccaacaccctggcaaacgtcaaggagctggtggcctggggcctgacggatacccgcttccagcggaccctgaatcgcctccgctacagcgacggcgggccgggcctgtggacccgtttcgtggagggcatccgtagcctcctgggcctccggtctgatgccgacacggccctgagtcgcgtcctggccgcctctgagacgatcatggacgccatgccggggtacactaaggctcaggctaagtgggccaacaagggcgctccggtgaccgaggaggccagcctggagaccatcgtgcggaccaccagggagcgtgcccgcgagggtgcgggcttcgtgaaccggttcttcagcgaggcggacctactggcacagcccggagagggcgcacggcgcctcctgagccgtcttatcgacgaccctgtacgtcgggatgggttcagcacgaacgacaacgcagcgagctatttgcgccgttaccggaacgagttcgagggctacgtgaagtcctacgacgagatgatggccaaggcaatggctgagcagggcgtgggcctgacggcacgtgcgctgaactcccgccgcgccatggcagtccgggaccagcttaacgagcaggtcacccgcgagctgctgcgccgggaccgggagtggaccgcctacggcagcgtccgcgtagaccccaacctgccgccgaccatcaaggccctggccgaccgctcggacgagattcacggtctgatgggtcagcgtgccagggaagccggggtccggggcttcgaggacttcgctccgcgtcccggatacttccaccgctcgtggaactggtccaagatggcgcagatggatgaggccgcccctggcctggcccggcgtgctatcagcgaggccgtgttccggggcatccctgggctggagcgtgccgacgccgacaccatcgcacaggccattgtgcagcgggcacgggaccgggctaccggtatccgctccgagttcatgggcgcgatgggcgtggcggacacggcattcatccggcaggcgctggaggaggccaacgtgtcccaggccaagttcgacagcatcatggccaagatcgagcagaagcagtccgaccagggcaccgtcaaatacggcaagggccggctgtcgctggacatgaccgccgagatcaaccacaatggaaccgtgtaccgcgtgcaggacctgatcgaccgggacctagaccgcctgatggagaactacgccggcagtatgtcgggccgctcggcactggcccgcgcaggcatgcccggcgactccgaggtggaagccttcatccgtgagtaccagcgggaggccgcgcacctgggcaccgacaaggtgcaggagctgacgggccaactgcggggcgtcttcggggacttcaccggcaacgtgccgcgagagcatcagctcggccccgtcgcacagcgggccagcgggctgaccagcgccaccatgctgggattctccggcgtgtaccagcttgctgagctggccacgatggctcaccgccagggcgtcttcaacgtaatgaaggccatgctgaactcccgcctgggtgacttcgtaggtgccatgcgtcgagacccggacctcgctgatgagatgcagaccgtcctcggcctgaacctcgccaacgacattcggatgaagccctggaagcggcagttcgacaccttcctggccagccaagacaccttcatggatcgcttcctccacgcgggtaagcaggctgtcccggtgctcaacggcatgaagttcatccacaactggcaatcccgcatgaacgccaacctcaccttgaacaaggtggcgcgggcggcgcagggggatgaagcagcccttcgcgtgcttcagcagtacgggaaggacgtggactggacgccagtcctggcgcgggttcgcggttatgtcacatacagaggaaggaacgcccaatccatgaattggggcgcctggagccaagcagacgtgaacaccgtcatgaacaccgcattgcggatcatggacgactcactgctgtacggtcgagtcggtcagaactcgggctttgcccggtcacctgtcggccaaatcctggggcagttccgcagctttgtggccttcgcgcacaacaagctcctccggggaacctatgagaactccggcgtgcttggcgtggcctcgctcctcgcattccagtatccgctcaccgcgctgatgatgggtgccaaggcagcgatcaacggcaagttcgacacctctgatgaaggcatccgcaagatggccatcgacggcatcggttacactgccggcctcggcttcaccgccgacatgtggggcgtgatcaccggacactctaggatgtccgccccggtcttcggactggcggagcactccaacgaggtgttccgtggcgtcaaggacctagtaaccggcgacgaccccgcagccgccaccggcgatatcgtcaacggcgccgcaggggcactgcctttcgtcaacgtattcccggcgaccaagttgctgctggaatccatcaaaggggaataacgtggctcggttcaagaatcccgagaccatccacgttgcagatggggtcgaggctgtcttcagtctcgacttcccattcctgcggcgtgaggacgtattcgtccaggtcgataagatactcaccaccgactatacgtgggtggacaacaccaacattcaattggccgtggtgccgaagcagggccaagaggtccgcatcttccgcgacacgcctgcccaggtcccggacactcagttcagccagggcatcccattcctgccgcgctacatcgacgcgaacaacaagcagctcctgtacgctgtgcaggagggcatcaacaccgcgaacctcgccctggatggcgtactcgacgcgatccgtatcgccgaggaagctcgccgcctggcacaggaagcactcgacgccgccaatgaggcgctgcgccgtgccctgggcttcgctgagattcgcaccgtgaccgaggactcggacatcgatccgagctggcgtggttactggaaccgctgcatcaccgctgacaaacccctgaccttgaccatgcagatggaagacccggatgcaccctggatcgagttcagcgaggtccacttcgagcaggcaggcgtgcgcgacctcaacatcgtggccggccccggcgtgaccatcaaccggttgcagaacaccaccatgcagctctacggcgagaatggcgtgtgtaccctcaagcggctgggcgctaaccactggatcgtgttcggagccatggaggacgaataatgcgcggcattatcgcgggcatcatggcctcccaaatccggcgtccaaaaccaatcctggcgacgtacccgtatcccatcctagctacagacgacgcatggtcctgccggcccaacatagtggcggcgctgacacgcgacactctgcacgaggttgtgaaccagccaggagaggacacctaccacgcgacctccagcgtggtaagcgtactgctgcggtcgctgactcagctcggctacggcggtggcgatgggttcctgaccggacctgccgtcaatgcagccttgctgcgcgatacggtgaaggaatataccgcagagccttacgcattcctgtcgcagaccgcagtggccggcgcagaactgaaggttgtggttgtatactccgagtatatcgtggagccgtacgccttcgccacctcgacagcaattaaacaggcggaactgaccaatgtttgagacacgagttaagggtcgctacaccgtgacccatctgaaagccacgggtgaagtcctggcacagtacaccttcgacaacctcatcactaacgcgggtctcgactggatttgcgccatggacacctcagacctgttctcacaggccctggccgtgagtaccagcacagcagaccccaaccccgctgcaccctccctgccggaggaagtacgacggaccacctcgtacgccccgaacggggatgttacctcgggtctggatggggagtggatttactggcacaagcggtggcgcttcccgataggcacccttaccggacaggtactggccaccgtgggcatcgtggcccaatccgaagttgggttcgagagtaacaccggcgcgaagattccggcagggactccactgtcctacacccggatcaaggatgccgccggccaacccaccaccctggtggttcaggccgacgagattctcgacgtgcagtatgagctgcgcagcaaggctgtggcgatggccgaggccaagttcgtgatctctggagtcgagcgtaccatccgccttactccgctgcccttcgcgaaccggcgtaacctctacggtgagcgctacatcttctacaacgagagtcctcggattgacggtaagaatgcgtccggctcggatgtccaggatggccagtgggtgaagctgtacccgcgatatacgcggggcacctacaaggggcagctaatgctgcgggccaccgttgataacggcaacatgccgggaggcatcaccggctgcaaggacctgaagatttacaacggtcggaactacgcactcaccatcgacccgcctgtagtcaagaacaacacgcaggaattctccatcacgatggagttctcggtagcgagggcataacccatggcactgatctacgacttcaacctggacctcgatccgaaggctaagtccaagttcgtaggtgcgcgaggccgtagggacatcagcgacgtgctagacttctgcgacgggggcgtggccatccaggacccgtcgcagggtatgatggtccgcgtgtggcgaacagagcttcgccaggacgggacctacctggggcacgaggacggctcgaacgagattcgcatcggcggaggtatcgaagaaggtatctccacgatgtccctcgacttcgacagtaacatgaactacgtgtgtgctttcgtacgagccgatcgaactggtgcaatctcctacttcaacgtgcagcagggccgccggctcctcgtggagcttgggcaggttgactatgccaaggtggccttggacgataagcgtcctggagctactgcctgggcacaggtcatcgtaccttacacccgtaacggcaacctgtacgtccgcacacagaacgagaactatacggtagagcacctggaggtggataccggcaaggtattccgaccgctggtcaaatgcggtatgggcaccaacctccgcttccaagtccaattcagagggcacatgtaatgagcaaaaagcagaccgcgagtgctgagcggctgggcctgctacacgagctggtctgcaccgctatcgagcgcaacttcaagtggtacatggacaacgacatcccgatccccgcatcggatatcgctgccgccaccaagttcctcaaggacaacgagatcacctgtgatccgtccgacaccatcaacatcgaccggctccgcgaggagatgcggcaggcgcaggccgagaaccgccgcattgccttggagggcttcatcgccggtgagaccgacgacgagatggaacgcctgtacacccactaaggaggcagcatgacgccgcaagaacgattccagatagcccacgaagtgcgggacatgtacccgcgcttccgggacttctgcctggacgccatgctgttcctcggcttcaagatgacgtggatgcagctcgacatcgccgacttcatgcaggattcgcccaacaaggcgatggtcgctgcgcagcgtggcgaggccaagtccaccatcgcctgtatctttgtggtgtggtgcatcgtccagaacccggctacccgcgccatgctggtatccggctctggtgacaaggctgaagagaacggccagttgatcacgaagctgatcatgcactgggacctgctggcgtacctgcgccccgaggcccgaatgggtgaccgtacctcggccaccagcttcgacgtgaactgggcgttgaagggcgtcgagaaatcggcctccatcaactgcatcgggatcaccgccgccctccagggttaccgtgctgacatcctaatccctgacgacatcgagaccacgaagaacggcctcaccgccaccgagcgggccaagctgacgcggcagtcgcaggagttcacctctatctgcacccacgggaagattctgtacctgggcacgccgcagagtcgcgagtcgatctacaacggcctgcccgcacggggcttcctgctgcgcatctggccgggccggttcccgaccctggaagagcaagagcgctacggcgactggctcgcaccctccatcctggcacgtatcgcccgcctggaggagaaaggccacaacccgcgcaccggcaagggcctggacggcacccgtggctggccggcggaccctcagcgctacaacgaagaagacctgatcgacaaggaactcgaccaaggccccgagggcttccagcttcagtacatgctggacaccagcctcgccgacgagcagcgtatgcagctcaagctgcgcgacctgctgttcatcgacgccacgcatgagagcgtacccgagcaagtggcctgggctgccgacgagcgcttcaagctcaagttcgacgcccaccgattcccggtcatcaagcctgagctgtacctgccggcgctgatggctggcggctgggcaccgctccagcagatgacgatgttcgtggaccctgccggcgatggtggcgacgagctgtcgtatgcagtaggcggaactctcggcccgtacatccacgtcgtgagcatcggcggctggaagggtggatttgccgaggagaacctggagaaatgtattgccctggctgcgcgttacggcgtcaaggtgatctatgtcgagaaaaacctcggcgcgggtgcagttggccagctcttccgcaaccatatgcgatccatcgacccggacaccaacaagccccgctatgaggggatcggcgtagaagaccgccagaagtccggccaaaaggaacgtcgcatcatcgacaccctgcggcccatcatgcagcggcaccgtctgatcttccacgtctcggcgatggattccgaccacgtgtcctgccagcaatacccagcggacaagcgcaacgagcgctccgtgttccaccagattcacaacatcaccaccgaccgaggctcactgccgaaggacgaccggatcgatgcccttgagggccttgtccgcgagctagcacccacgctcgtaaaggacgacgaagccgcaacccgcgctcgtgaagaggctgccaagaaggaatggctgaacaacccgatgggttacactaagtctgtccttcggtctctcggcatgggccgggagcgtcgcaagggccgcccaaaaggacgaagactatgatgctcgataccgccaccgaggcgggcaaaggcaccctcgccgtcaccggcgtggggattgccgtttactcgccctatgagatcgccagcctctgtgctgcggtactcaccgcgctctacgtgggcgctcagctcatcaccctactcccgaagatgctcgatagcatcgcggagcttcgccggaggttcaagaagtgaacaagcccctgcgcggcgcagcccttgcggctgccctcgccggccttgtcgccctggaaggcagcgagaccaccgcctaccgggacatcgccggcgtacccaccatctgctctggcaccactgccggggtcaagatgggcgacaaagccacaccggagcagtgctaccagatgacgctcaaggactaccagcgcttcgagcgcattgtcctggacgccatcaaggtgccgctgaacgtcaacgagcaaaccgccctgacgttcttctgctacaacgtgggtccagtctgtacaaccagcacagcgttcaagcgcttcaaccaaggccgcgccaccgagggctgccaagccctggctatgtggaacaaggtcacgatcaacgaccagagggtcgtatccaagggcctcgtgaatcgccgcaacgcggagatcaagcaatgcctcgaaccatcgtcgcaatactcgtccttgctgtggtagccctgggagcctcatacggcttcgtccagagctaccgagccttgggtatagcccaggaggagatcaagcgtcagacggcccgtgcggaggccctggaggtgcgttacaccaccttacagcgccacgtccaggaggtcgccgccaagaccaacacccagcgccaggaggtggaccgtgccctggaccagaaccgcccgtgggctgaccggcctgtgcctgctactgtcgttgacagcctgtgcaaccgccccggcgcccgctgtgctgtgcgaacaccctctgattgaccctaccacccaggctggcctaatccgcgctgtagcggcctatcaggacgccctggacctatgcaacgccctgaatcaaggagactgacatggcgaacacccgtgatcaatacctcgctggccgtaacaccggcctgaccttctaccaggtctgccagcccggcaccgacaaccgcatcgccctgcacgacatggacgaggccgatgtcaaggctaaggccaccgctgtgattgcagcagcctctgccctgggcggcgagggtggcgctactccaccggacccgctcaccgcctacaaggtgaagaacggtgacaccctgcccgtggacggcggtggctccgtgaaggtgaccgtagccaacggtgccatcaccaaggtcgtgtacaccgcaccggcgggctgagctacagcccgtccaacctgatccacccataacacaaggaactgaaccatggcaaccttcgccgctgcaactcagaaagacctccgcgccttcgccggcaccatcgagaacctgatccgtccgctggaggaagcggccctgggttctggctacaacgagaccaagctgcgcgctgaactggtcgcgcacctcgacgagctgatggctgctgtcgagactgccaaggcgctggtctacaagtgatcgacgagtagctcaagccgagcacctgcacagtcgggtgctccactggaactactggaatttttattgagggctggctgtgggtgggagttggtagtggtgggcgggagtagttactccgggtctaattttggtatcgtcgtgtgagaaccctcccgactctgatcagcccacccttcccccgtaggccctccgcctggtgggccactgcctcgcattgcctgggtgttgcctgggtcatccctgggagcttccagctacgctgggtggtggtgggcttccctgccctgtcgctgtcctgtcgccgcccattctacgcatcctggcgggagtgtcaacccctgggtggtcggtgccttgctcggctacgctccagcgcttccgcgtggtcggctaggcggttggctcgccagcgcttcgcccactctacacctcgctccacctcggaccacttgtccgccagcatcatgcgctgccatgccgcgtcctgctgtagccatgccctgctggctctgtcctgtctgctcagcatcctctgtctcctctgtctggctccctggggcttccctggggcgctgctgtggtcctgtcgggtgatggtg

SEQ ID NO: 4 - DNA, 93744 bp, Myoviridae Pakpunavirus
  misc_feature (1)..(93744)
gcttacatccgctcccattttgcaatggaaattgcatacagttcatcatgcgcttcaaaagtgacttcactttgcatgcggatgcatgctatagtataccctgtgatagctccgctatcccgttttgcatggcacacgaattgcataagcatgacaagggtaaccctcgaaagcggagctttcaaagtgtaggctgagtgtgggctctacctctattatatttgcgaccggaagtagtgacactgaaaacgttgactctagcccagtaaatacgttaaactaaaaggttgatagctgccgctatcgagtaaccaacattcacacaaggaggcacaatgacaagcaacaatcatgccaagattcacatccattacgctaagcaaatctactacgccatgcgtaaacgtgccatcgcaagcgatgagatatgcaaggaatgggccaagcccaagacaggctttgaagcgttctatgattgggtggtgaatgtgtcagggtacgccgtaggctaccgcctagacaggaatatcctcttcccgggaaacaagctctatgctccgcatacatgtgagttcacacctacatacatgcatactctattcaccaactgcgacaagacaagcaataaccgtgccaacaatgatctacctctaggcgtccgcctagcccgtcatgacaagtacggaatgccagtatacgtctcacagtgcaggacactaggcaagcagtctacccttggatcgttcgacgatccgatgcaagcccatgcggcatggcaacatgccaaggtagcagccatcctcgaatgtattgatctctatcagatggaggatgttcacagtgtaaacgttgttcaagcgttgcttgaaagagtggacaaacttggcaaggatattgcacagggaaaagagacaacccttttgcaatgatttgatggggtcgatggtcaaccctctgagagtgcgagaactccgccagagtaatccgatagcgaagctatcaaacgtatatgcatattccatgccaacatgtggaaagatttcacccggcagggcgggagcccgttggcattagttttgcatagcttagctgtcgctaagaaggaaagaccacggccacccattattttggatttactaagggttagggtagcgaggtgggttcgtggttaagtagctcggaaataaatccataactggcagaaggcgaaccagcagagggcaggcccgctccctccattattttcccagcagtagaggaggcacactctacaaacgtatcactctattcggcgggggtttaggattcgaatatacctttagcggctaaatgccatcattgcttatttcctattttcgtgctataatccttataggatgttcttattcttcattatagctggataagcgatggttgtatagattcaccacaaatagaaggaatatagaatggaagataatattcaagctccgcttgcagctagtgcaggtggcaaattcgcaactgtatacgaagctattgtcgcactcggagtagaaggggctgccgctgtgtacagggtaggtgtagggaatagattgacaacagctagaccatcggcgtggtaaagagaagccccgggcagcgaaagctgatcccggggctttttattgccttgagtttatgtatgaagagattccagttgtctctgctcttccatatactccctagtggcgtagttcatcatgaggttgcaatactcttcgtttatctggtccatgtattgcaacactttctccatgctctggcatggactaaatccattatgacggagaatcttgcttagattaccctcattccagaagtctctggcccaagcctccaaagctactgcgtagaggcttttgatgcacccgataggggatggataccaatattgctcagacattagaccctccaaacgcagcaaacaccccttgcttagctaggatagtctttagctcctccagtgaaatggtctcgtctcctacgaccacatacttgtctgccttccctagagtcatcacacacttagtctggaaggtaggccgatacaagtcatacacatcgggttgccacttgcttcgcaggccagttccgtagctaatgaaccggtcttcgggatgatcccggatgtataggcaccggggactatcatctggcccatctacggagatagggtgttccatccactccctgatcttatcaacgacgccctctcctaccttcaattgagcgtactgacagtactcaaggaacgcatcaaactgttcggcagtgaaattgctgacatcgatctctttagttttcattctcttcctccatgtctgcaatgatttccttcaacgcttgaagcgtgtaggtgccatttagctctgtagtaggaccagtgtcacactcatgaagcgtgtacgcggtcactttcttctcagtgacgaaatggaagtctacccttcggaagtcgtaggtcgatttcgagtatccaatggcctctttgagttcttcctcgtaccacaggaatgtcattggacttccgtcgcttttacgagtgtagtccagcagattatctccaacccacagtagcacttgagccttgtcgtacatgaagccgtttccgctcccaaactcgataccataagccttaaggtgctgttgtactgcaatgttctcttcgggggtcttcacaatagtgtaaaacttcaccaaacgctctttcaatttcagtcctcctgtctgtgttttatgggagtgtaaaacgttcccagtccattgtcaagccttctgtggtgatagtctgttccagacgctctctagctccttttagaatgatatcccactcatctccttcttggacccctacatacttctccatcatcagcgcacgatcaacaagcccagctctgtagttctgtcgctcttttctacgcgatagcactcttgagatatggtccttcttcttcgccaacacgctgatagctttccttgccataagagttgcatactcgctctcctcggcggtcatccattcctgatacagcagccctagacgagtgtcatgctgtacgagtggaaggtctttccatatgatacctactcgtccagtatcagagacggctttccattccagcgtagtgccgccggtcttatagtcggtgatctttacattctccgagttagattgagactggaaagcgtgcctccagtctcggtatacagtccaccgtttccagtcgaagaatgtctcacagatggctttaacaggttctccgattttaccctccagttctttcaggcggttctcctgctcagcactcatgtatttgataggtcgggaggctggatcgtagcactcctctacctgaaactcctcagcccgagactccaacactttaggctcatcgttactttcttcctctcggaaccatgcgaacagcttcttaaacatattcagtcctcctctcctgtgatagctaccctagtcagtctccacacttttctaggtagactaacgaggaatagcatagccataaacggtacggcgataggccagaatattccagctaacaccgctcgggcctctttcttacgcctctccgtactttctcccctccacccaagaaggggtcgtagagattcccatacgaacatccctatcacagagtagaacaataggcagaccactccgacgactatgcatactagaatgagaagccctacttgttccatggtgcgatcctcttaagtagtttacggctgttccagatagacagagcccacttaggtaacaacaccactttcaaaacgctgtatgttgcgtagagtagcagaaagctagcatacactgtgaatgtaataggccatagcagtcccagtacaatggcaaaagcctcgataccctctctgtgatctttagtcgcactagctgggaagttatctttgaaatactccgtgatacccatgtaggtccacatgaacgcaattccccacgcgagcgcgaggacgaatagcattgggattatctccattactcccctccttttcgaatcaagtcgaagtaggcccacacgtagaagttgcaccacgctctgcctatggcccagccttcccaatagtcttcccagtccttgttcggagggttattctcgaacatggataacacgcatgaatcagctacttcgtccaagaggtgcattaccgaattaagcggcccgattccaaaggtcttatctagccaccccttaaatcgtcccacgtctgagacggtgacgctggagtcactgcacagtgccaatctctccagaatgtagcacatgtaaggctcttcttcgttctcgaagaatgcccgcatgccttccttgattagtggtgcaatactattagagttcattttccctcctttcggatcaggtcgaaataagaccagacataaaagttcatccagttcgtctcagtgtctcttagacaattgcgatgaagataagagataactgattcccacgacgtaatcccgtgctgctctattagccactctctgaatgaccgatactctccgtgggtgatttgcccttcttctactaggtcactcaggatataacacatatatgtgtcccgggcgtttaccgagtaatcttccagtccgatctttatcaactctgcaactgatctcattgtttcctcctctgagagccccactagggctctaaatttttggttcgacctgcggtcagcacatcacaacccagttgtacaggtcggcctcctcataagctgatgggtagcgattgtactccaagaagaacgcgtggtcaatagctgagtatttggttgcgaaactcgtaatgtaagtcagaaacccgttgtcctctttcctgaacagggcgtattcttcagtaccgtccttaaacgtatctagcgagatagtatacttgtcgaagatcacagcatttcctcccggctaatgtagtagttgtagttgtcctcttggacgaggaacgcacgatagaagcctttctcaaagtctcccttgaccagcaccagattgccctccaccttgcatgtatagatatacatggtgtttgctactcggataacaggatcatccccgggacgaacatccagagcagagagcatagcctccattggcatgcttgtcaagtgtgcaactacagccgagcagtattctgcatcgcggccagaagtgtcctctgcataagcaggagcgaccccgcacgaatgcagggcgagtgtaaacgcaatagctacgagtttcttgaacatactaaccctcctcttggtctgtctggggaacatccggctttgggtagacgaatgtctctggatacttcatgcatcttagctcatctttgcagaacccgtcaatcaatttctcatgtgcgaattccgcagccttgtagtagcgattagcctgtcttgcctccactcgaaggaggtggcttatcgtgtgagcgttgatattactaagacttgcaaaaattgtcaagagcttttttgcagaaagaggaatcgacctttcatcgggtctgtaccagtccagccgggcaactccttggagaacgtcgtctacccacaacgggtagtctccgtctagctcgaccatgacttcgtacatttcaggctgaacagcgttgaaaaagaaagagggctttcgccctctgctggtatctagaggaggaacaagccccctctccaccttgtgaatcaaccgatcagcattcgcccctatccgagactttagctcctcgatctcttcacatgtcaacatacggagggcacaccttagatttctcgatagtgaacacgccttcgcatgtcaggttagcaggtccataccacttgaacatgttgttgatatcgtatcgaatcaactggcggaacttctgcccgtcgcacatatccacgtcgaaccacgccacgacccatctgacgtaatcttcagggtcgttctcttctcgccatctgcactctagatcaacgtgactgggctctagaacgtaaatgtcttcgaaccctgtactctggttgttcttaagtcggatgattcgagcgcgaatccattgcatgcacctgcggtttgggtctgtgatatcgcagactaccggaacctctggaacctcaactgtatacatgattgtacctctatttgttttacaagaacgccatgattctgtctctgtctgcatggcggtacagattgaagcaaggcacgcctctagaggacgccagttgccaagcggtcctagtcccgccttctggaatcccgttgtggtctgtcttgctccagcacaccaagaacttgctaggcgtgttgagatcgattcccagcacttggaaaacgttccgagtgtgggctcgtcttgcgaacgggcttagaacggacctcccgtcatttctgacagagttccaagccggatgaatttgactggcaatgcctttagcttcttcccattcagccggcaactcttcctctggcaggatggtagctccgagcgtctccgttatctggtactggttgaagccgggagacggaagatagatttctgccgtagttcctcccttgttattggatatataatccagccagcccgattcgaacgctgagtccgctcccttcgctcctcctgaccgaagaataaaaccttgttctgccagtttacggcctacctctcgaaggatgccccactctctgtttggcgtatccctacttccgactcctgtgtaatacttcataagatcaccatttcggatagctcttctggtgttacccattgatgccggtattctccgttcttcgggttagaatattccaatagaacagggtaatactcgtctcggtaatcggtgtctataacctcgcagttccaacctacagggataggacaagaacgccccttgggggccatcttagttccaatagacaacctgccttgactagccgcctcattgacgcttatcaggctgtatctgtgttttaacgcttcaactaccttgacttggaggtctaaaagttcctcgattgtaaagtggcttacatcgattgtcatattactccctcccttccagtttcttgaattctttgtccagcttagctagatgcttatccaacttgtctagctttttatcctgataaagctggaaagcctccgagcccggggccaaccaagtccccttatacttaattgcaccccggatcatatctcctcctattacagttcgtaaacgtatacctgaaactggccgagcgtctcctcgataagaggctcgacattgctccagtcctctccggctaaaccgcagccaatcttcggcagacctacacacaactccgaggtaggaatcgcccgagcgtcagcctctgcctcaaggaacagagacatagtgtacagggcttggcccagtgcgtcaagctgagtgtagactcgtccctcttctcggccatagttgtactgcccgtacagattgtaaatcgatccatactcgttaattgtgaaggtgagggagccgagtttgcctcgatcccctttcaccgttgcttggtctgcctcgtaggcctccgggaattgctcccggatttgcttagcaatgccgctgcccatggtgttgaagcaattagcctgatgtgcaatagcgtgcaactctttgtttttgaacgcggcgagcaggtcgccctttcggtatttaatcatttgaacctctctacacttgtgaatctgacttcagagcctctcgctccgtgagcaatgtccgcgtacattgagttaatggcagcaaacggggaccaatactccttctcccagattttgaacttgaacattttgtgccctttattttctgggcgaccttgttcgcagaaggttgtaaagtaatatttagctaacacctttatcctccttatactccgttcttaatccgataacggatagatgccaagtcattgttcttcaggtcttcggtgtcccatttcccgtctttgaagaacgtccgcaaggaaccagtagcctcctcctcttcagatacattatctttcaactggaggaatcgcccattttgcaggtctcggtacactttcaggaggcctttagccgacttcttcttgctgtcagttttcgggtctttgaagattgcaatgccttcaccgttcacttccgtgtaggtagctttcactgcgaatccgaaagtatcccgggtgttgcactggtaagtgtaactgccaactccaaacactacgttcagggaagcgaaacctttctccttcaagcgctccaagattttagctgctcggcgagttgtaatggaatctccatagatcaaaccgatatgagaatcgagcatcttatagcctgcttcgttcacagtaccgccgaaggtttcccacagaacttggatagctcctttcacctgcgcctcgctcacttcttcaagtttatagccaattacatactcgtattgatcccactcagtgggaataaccttgaagtacttatcttcaaagttcagaacaaatgcatcgtttccatttactgcatccatgatatcccagtgttcgagcgactcgacaacttcaatatcacccagtccgcagataacctctacaggatcaccagagtctggacgaacaaccagcttgccgtcacgttccatgatctgatccttgatggacggcagaatgtcagtaagcacgccccagaagtcgaagctgtctgccacgtaagacagaataccactcgggaacttacccatcagttcaacaaggaatcgacgttctgcttcctcacggccacctttaccttctccatccttcatttctttctcaatgcggaggatgttactagtagctacagcgtgttcagtcgcaggaacggagcaagctaccaaaccagtcgcgttatagtagtcctcagcataaatagctgctgccaatgtgtccgaacctacgaacgaggtcaagtgaccaacaccactacgggctgcgtcttcgatcccgctcataccccgggcactgaagtcgtggaactgaacggacagcaggaagtcgtcatagcatccagtgtgattcgcgtagtatcggcccatagctgcgtattctgcggcgatagtggcgttagtcgcggtcttccaagtcatagcagaaatcagtgtttcgtggtagttcactagccagtagaactccggcagggtgttcttgatggtgagaacaggcacgcccatcggtacactgacgccttcagtcagagacttgacctccagaggcagatagccgagcttgtgtagggctcgaagctgctccacagcctccatttcccggccaaaatagccagtcaggaaccgggcataccggccaacggcgttctcttcttcagccgcgaagaagccttcccaagactctacgatctccatccaagcggcccgtccgccgacccacttgagagtgccgtcgtagaagtcggtggcatgcgtctttcgataaatcttatcggagcgaggggtcaggttgctatagacaagctgagtcccttccgagtacatggaaccgtgtccaatcttataaccatcggtggaaagatgtggcagaattttcatgttatttcctcctgttgtgttgaataggcccagactacatcaatctgggcctcctgtcaatattcgacttcttctactggcagcgtcagcacagggtagatgcatggaaggcgcagcaatggttgcttcttgctgtggaagtcttcccaaaacttatcgtgcatcgtcttgtaccgagcgtccagttcctccttggtgtcgaactcctccaccttgacaaccctcttctctggagccgaacgcttatactctacaatccagatactcaagctcacaggcgttccgccttggagtattcaaccggaatgacagtcagcgcttcgtgctctttttgagggagcgtatccgaggtgtagatgcatccgaaggaatccagcaagcagtcgatacccttactgaagattccatgagtgacgaacaggtcagggagcactttactgtactctcttagggccttagacacgcttcggaatgtagcacctccgtcacagatatcgtcgatcaccagaagcggaagttcaggatcgatatccgaaggattcagaatttcaaagccttcgattttaccggtctggagatcgcgcttcttattgcaacgaattacagcggctgctccggccttctttgcaaaatcctcggtccgctttgttgctccgatatcaggggctacgagttgatattgctcccactctgaacggctcagtaggccaccgaagaccgaagattgacggacaacttcgacgttgttaatcaggtgcagagttgcgtcgctgtgagggtccacaacgataactcggtcatatccggcagagttcagcatgtttgcaaacactttcaaactgaaggcgtcgcccggattgcaccgacggtcttggcgagcatacgggacataacccagcagaagagtcatgtgcggattaatcatttctgctcggatcgcctcggtgacgttgagaagagccatgatatcatcactattctgaatctgagctttaacgtttacgaacgcatggctttcgatgccgcccacattaacgcccacttcgccgcccgggaacgtccacacttttgcctcttgccacggacggctcataacaccttccatttcctgaaggcaacctacagcataactaatcatacatcctcctcacagtttcacagagaagcgattccgcattgcttccatcgtgctctcgggaacatcgtgtacagacttattcccatgacgattctctacaatcagagagataacagtgtagccaaactcttcagccatgtcaatgtatggtgctacctctcgctcccgggtactagtattggatacgataaccgcatctagtcctatctccatagaccgtcgcgctttgtccatgcactttttgtgagattcaactaccctctcagctttccacacatacttgccgaactccatttggtaatcgtccgcttcgcagatagacgcctgccggcctgactcccaagttttgttatacagaatctcggcaagagaggacttcccggagcccgggagtcctcgaatgatatacatgatcttttcttgcatacttcctcctttaaattcgagccatatcgaagtaggtttcgatcagaagtcgtcgctgtgcatcggtcatttctgagaaccgagcctcatccacttcatttaccaagaagtctaccagaggatagaactcttcgtcaagcgtctgcttgaatccagccgggtcttggtacatcgcattgaccttcttactacccatcctcatgataaacttcttgccgaggtagtgagttgacttgcacttcactgtccctagccctgtttgtaccatgtaaccttctttctcacaagaactcagaagaccctttgcatgttcccagctacactctatgtgctctggacgaagaatctttacagaactgtggtccgttacacctagggcgtgagagtcaagaatatattctgaaagctggcccccagtgaagatatcgcggataccgatcaaatatgccccttcttcttcctcgacaatgtgagggtcgtctggagagcatatctcgaagttatatgtgaagcctgcgatgtaatcatctgggttattcgacacatacttctgaccaagggcaacgtaatcgccggtcaatgaccccgtagtactgaagataagggagccattgtgcttagtcacggagaacatgaatccattcactttctcaatcagccgcacacggaatttaggatggaggaaactcccagcaccattctctcccagattaaacaccttctcgaaggggcgtacaatacaatcaccggagtgctggtcaaatacatgaccccgtgcctccagaagaagcgggtgcttgttccacaagttgtcgtagaataccttacgagcgtatttaataaccgacataccgttgaagtgcttaacagtcaccagcttattagcgatcaggtctttgtacatctcaatatggagtttaccttccatcctattcctccttattctacttctacaatcgggcagaatttagacttcttcgctttcaaatacgacaagaaaatcccatcctttttatcgggcctcttagacatcagtcgagcgagccgatagaagaccgatacaccatagaatacagccgctacggcaatccatataaaccccataatagccaaagtcccgcctagaatgtagccggtcgcgggtccaagtagcagtgcatacaggctggagcctataaccgatgcaaatgcgactgaactgagggctagccacactacaagaaagaccgtttgccagaaataagagcagagagtaacgctcttccatccgctggaaatgtccaagtaggtaggactttcgaatttacgatgcaggcgcatatgccacgaattcttattaatcttcatgcttgttcctccgggaagatgttgaaattgagtacgttgtgctcttcgagttcgaaagaagctaccatcttgtagcctccgagcttgtcaacgatctccagtatactctcgatagagaatttgtcaacatgctgcttcatcagattagagattcgactctgatgagtaccacatctctcagctacttcccgctgagtgaggcccgactgagaaatatagtgtgcagccactgccattacagcctttttgaaatcttgaactgggttgctcatgttaatcctccttattactcagtgtaatttttccgctaaagactcgaaactggctgatctcgaactggtcagtccagcgagcgtcttcgaaagccactccttcgaaagttccatcaaacttgacgtctgaagtcatcagtacaatgaaaggcacgccttcatcgtggatcagctctacaagagtattagccttgggtgtaataccgttttcttcacgtgaaatcaacacattaaccatattatcctctctgtccgtcatggtgatctactaccacaaattcttgattccgcatgtattctctcacttcatcgtaagagaatacctgatgatctgggtgattgtcaatacctacatcaagcctctttcctttggaaggcaagctgccgtgagtgtggccgtgtagatgccaagcaccatgatgagcagtattccacgtctcgaaagggtagtggcacatcacgatcttcactccgtcaattcgaatctccttgtactcacgaatgtcttctacgtgagagagattgctatcagcgatcaacttccacagacgagagtcgcaatggtttcccttcaggaaggtgatacggccattcaactgcttgatgatatccagcacaggctggagcttgttctttcctgcaaatgcgaagtctcccagatggtacacttcgtctacccgacctacccgggagttccaccgagaaataagctcctcagtttgctcctcgaaagtccaaggcctgttgcagtattcgatcacattcttatggaagaagtggagatcggaagagaaaaatacagacattatgcctccttttcaaattcataaatcttgttgatcctgcggatcagtcgaatagcagcccctcccagcagatgctctcgatccggtttcatatgggccattgccttgaactctgacagcatatctcggcgttcatagtggaagtctactacccagtaggtgtctgcattaatcttaccctctcggtacaggtgcccttcaacaccaagccagtggtctactgcgtctttcttcagtaactctttcggagaccacttgtctacaccccgcaacttctcgaagaaagagtaaggacgagaatagttgttgatggcttcctctacagccgactcagcctgcaatttaatgaactcccatcttgcaagaacttctttaatctcctcggtggtggctggggtgtagctgtactgctctttatattcattccacattatactgttctcctacgtagcctttgaatttgtcggaacgggttgtcttcttctgtgccttgttttccagaaccgatgcttccctttcgagcatgctcagttggttgctatacttcttgatccgtttcgcattgccactcatcacagaatttgtaagattggcaatagtgtcgcagattttaacctcttttgcaaccggatgattacggcaaccctcgatatacttccgatagctttcagctcggtttttgtcaagaatgaccagagcctctacgatatgcggcatcacgcccatagactctaagtcctcctctgtcaggtcggtatcctcaagaacgtcatggaggaagcagaccgctagaagggtgtccatgtacggaaagtccgagaaggcctgattcgggtccatatccttcggagcattacgtgctacgcagattgtatgcacttggttcagatggtaggcatacggatagttggtctctccataccgctgaccttcatgggccgagagtgcgatctcgatagcaataccgagctgagttttcatgttaatctcctttgtagaatgtgtggttgcctatcttgatggtacgcttgtacttccgagcccaccgagggagcctgccattattggctctccttacctttctctcgttcaggtagtggtccgctcctcccgttggatcaacagtatacccatacagagcgttgtatgcaacatgttttgctgtctcccacttgtcgggctccttgacgccctgccgcatgctaccatcgcaggtgtacgaatattgacatttgaagtataacactccagctacggtgctgggccacctgtcgtgctgcatcctgttgatgacggtatgagctacagcaatctgcccgatttccggctctccacgggcttcgaagtagaccgcttctgccagcagtctgcaaggctttctgtactcgcacagtgttcgcttgctttctatgatttgagcgggactggcttggaactccactacaggctccgtgccgtattttagacgagagtattccatgtcgaggaacatcccaatgaaggctagaaggatcgacaaaacgagagcttctaaggtttccataacacctccttagacaaagaagcccgccttgtgggcgggctgtatatcactcggctattatacttcagcccaagttgtaacgacgggcgtagtctttgttggggaactcgaccatcatcgactgaatgtgaatgttgcctttacgatccttctggattttggcatttttcacaatcttacaggcctgcgccttagccataagctcagggcttacaaccagatcgatgaaccctgcactccgatacccgcatccggcaggggcccagaagccgtgctgggtcatcgtcgagccgggaacgaggtacaggttgtgcagacgcacagcagtgttgaaactcagcttgctgatatgcttcgcttcccgagtttgggtttcaaaacacccagtcgtgtagttgaatttgtaagtgagagcatccatgaactgaatgacgcttcgaatctggatagcagaagtatccaagagctggaactcctcagccgcgtcgattgcagtggtcacgttgacagacttagcgttgaacattttatatcctccttattcttcagggacaaatacaccgccgattacccagccagcgcgaattagtttaccagttgggaactgagcacgcaaggtctttttgaaacgactttgaatttgcacagttagccacttaccccggtagttctcaaaattagtgatctgatccttgcgttcgtcaaagtcaccgtacgtcacttcaagcagctcttgaggtacagggtcaaacaccaccagaacagcgttcccattcttgtctaccacgtagttcacgatctgcatttccatatcgaagaactctttgtacttctggagaccgctggagcgcttaccagattcgtacaagccctctgggctgcgccacatgataccctcataaccgttctgacggtacacgtcgtgaagacgtttgaggtcttcgaaagtggagcagaatacgtactcaacgaatcgaatactccccagatcactgtgtagtgcagactggaactggaagtctaccagacgctccttgaatgtcaagccttctttcacgatatcgaatacgtgaaattccagtcgctgccgcagtccgtaaataaacgatgtgctatctacttccttaaggagccgatcatactcctcctctccgtcttcaataggataggcgtccagagctttctcggccttcatccacttgtcgtaagcatcctcccgcttaaccgcagagttgatatcttccagcacctccccatggacgtacagttcgccgtcccacacatcaccctcttgcatgatctcttcgagttctttgatgatgtgcggtacattgtaaggtttacccatgcgagacgctagcgtaactacgccattggctttcttagccatgcaacgcaggccgtctagtttaggagagccatacccctctttgtatttagcgggatcaagcggttttgcgagcatagccataacagggagatcgttgagttcttccttggttgcacgataacccttgtccaactgcttgctcaccttggactgagcctcagacacggcctgctcctctacagagcgtttctgcttaccaactcggatgttggtaacctgagaggtcatggctccatgttctttgccgtatttcacgacgatattgaagctaccgtcttcctctccgaccacctctacagtccactccttgaacccgcctttcttgtcgagtccatacagtcgttgaaaataactcattgatcctcctcgtatttgatgacaagaacatcattctcccgtaggtgcctaagaccttcgtcgagccgatattcgtgcttatagtacactactttgatcccagcttcaaccaccgagatagcacaatttttacagcaagagtgagtgacgaacagggtagccccttgggcactctcagggctgcgtataagggccctcagtgcgttttcttcggcatgcctcacctctgccttggttactcccgtttcgtcctccagcggcccgtttaagtgctctggaagggcattatacccgcaactgatgatacggttacgttttactagaactgcaccaaccttggaacgagtcgagtcgctgcacttagcgaaggcctcagcggcctccatgtaagctttaatatgcttaaccttcacacctagcctccgccgacgaggacagcaatctcctcgtactcttcagtggatgcgaactccatgtaatagtcgtccgtatctgacaggtaaacaacgataggcggataataactccatacagggtctccgtgttcgatttcagctaccctcacattgccatacactgtgcgaagagtctgtagagcttcgatcacatcgtcaatacgcattacagttggttcagtcatacctgcctcctcagttttctactttacaaacggcatcgccgcgtcgaaggaacacttgcactgacggctttccgctccacttgtcccacgcttcagctttaacactgacagtcttaggattgatggcaaccacctcgcctaccagcataaccattccagttccgcctaggcagaatgctactgcgtcgccgatctcgatatcccttcctgctacgtccttcatttgtactctccatctacacccttgattaaaataacgaagtccgaggggtcatcactgccgtaggcctttgcccgaaactcctgctcgtatttattcaccgcctccggatcacttttaacctcaagctcttggtagaggtcttccataaaccaacccaagtccgtggtcgcagccgaagccgagaggtgaccaagaagtcctaccagcatattgatctcgtcgctctccaactccaacttgtgaccgttacgttttactactttcatatttcctcctatcgcttctgtccgcgacgagtggctacgccgtaagctggcttgctcccctcgcccgtgttgtgtttcttctgcactcggctggcattgacggtgtaacgccctttgccatactcttcatctatccacgcttgggccttagctcgctgagacgtgtggacaaagatgtagtagccagatgcatccttgataaaccaagtggccgggggctggaagtccagacgtgaaaactcttcatagtcgatcacagtcaccttctgcttagccactgtatactgccccactaccgactcttttgcaatgattttatcaatcatctgagttgaaagatcagagttcttcgaggtcaatttctacctcctttcctagtccagtatctgcaaagaagctatcgagactcagagcgtggtattgagacactttgtaaccaccactcttcagaaggctgtgagcggcctcctctactttgtcctctgtcagtctccagtccgcacctaggagtacttcagctaactgctctacactcggagggttcccaatccacagacccattctactgtcaggctcgtaatcttcttcccatacaagttcccacactaggttactcattggtacacctccttcttacgaatagaatacataacccactcgtcttttcctgtcttcccgcacggaatgtctacttcacactctgcgtttacaatcaggcccgctacgatgaaatcaagaagctcctcgtctggctctggtaagcccgggtaggacgatacaaccctgcggatagtctccgatttggtattgcccagtaccccaagcatgtggaggtcaaactctccactgtagtcgtcccagagttgtccaaatatcacccatacactattcatacctagtaatcctcctttagcttgttggtgtccattaggcagcctccttcttcttgtccagcaacttcaggcatcgtttgcaggtgatatgattgcggtagcgggagaagttcttctcctcgaagtcgccatcggtgccacagaagacgtcatatggttcttcactgtccgcttctgtgccgccgtcccactcgtcgtagtgaactgctcgcgtcgccattcacttcacctcgattccggcttgctggagggcttcgacgcactcatctcgataagcttgaaggtcttcgtcgaatatgactctcggcaggtccaccctcagagccgcgcggctggctttccatgcctgccacatcagcgagtagcggtgtgctgcttctataagagccacgtatacgtggacgttatcggtcttcacaggaaagtagtcggtgttacgccactcgacaccgccgggaatcgggaaacagttttcgaactcctctctcatactccgcaatcctcctgaatttctttaagaagctcagagggcataaccgacagagccagttcctccagagcatggatgtaatcctcgacatatttccattcctttctgatcttctgaaggtacacgccttctttgctgttgtcgatagcctgaccttccagctcctgcatcagttcgaacattttgtatatcctcctatggccgcaaaaatggccggcgactactgtcccggcctgatgatactactctgaaatttcttccattgcaagtcgtttcttttcaaagaaatcgctgagcttgtcttctagctcttcgccaccgatgtaaagctcttcccctgcctttacacgctctagctccttctcagtcaagaagtcactgtagacgtgatctacccatttatcgcaccacgctgagctaaacgctgcattcctcaggctattcctgaaatcagcagatacaacgccaaaagaaggcgcgtggatcatgaaatatgtgaactggtcgatctcaacggagtcgcaggctagcgcgatggcagtcatggcagacgcacactcaccttcgagacgagcatgcactggagcttgacactccttgatcgctcggattatagcgttggcggtctctacctgtccaccgcatccgttaatggtgatgtacacttcatcattctgacctgcattttcaagggtccaaagctcctctgtgagttcttcgaggctctttattacgtatggcagaaggatggagtaacgattgctaacactttgtgtacatgaaacaggcataatacctcctttacaaaaatgggcccgaaagggcccttattactgaatcactcctcgctttctttctggccagagcccagcattgcaaagaatggaaggaggattgtgctcagctctccgctgacagcttcaccaacttctgcaccagcctgagctacactcaggaactcttcagtgcgtacaaacttgtcaaccttaacgagggttttaaagtctactcgttccaagaacgcagcgccggctgcttccgccagaggttcgaggtttacgacttccatagcgcgatccagagcttcctgattgatctctaggccgttctgtgcggcaacctgcatcagggtagacttcacagtctggattgcgtagtctttgaaaaactcacgttgtgctttgttaaacttcattcacttttctcctttgtagtacgacgacggcgggtttttggtttatcttccgattcagtctcttggacttcctctacaggaacttccttagctacttctgtagccttttcctcagtctgcttctctgcaccttctcggaccatcttgacagacttgagagcgaaattcatgttagcgaagtgcgggtcttccacatcaattcggaagccttggtcaaaggcgttctgcatgcccatcagaagactgaaaacgtcccattcttgcacaatgacttcattgccgtcaagctctttttcgatttcctcagaaacgccttcctgacggaacatctggacttgacagagggtgccatacacaggatagccttcgatggagcggacgactcggaaaccttccttcatgtgggcgtgaatcgagcgaagccagacgatagggttgtattctacgatattgataacttgcatattcttttactccttgcgggttagtgttttacaataataccacgtttctcaggaatgtcaacccattttgttctggtagaggcttgacatagaggaaatctgtggtattatcaatattcagcgtgggagagatatgtctgaaagcactcaccggcccacgcctagcgcctatgaagaggaatccacaagggcaacctgaactcgaatgctgttaaagggtggagacgacgcgaaagcggaatgacagcaatccgatgcagcctacatgctgcccctcaccgaactcatctgcatgagtaagaggaattggatagagccaaggcacgtcttaggcagattaaattctgtatggcgagccttgggacgactctatccttccctagccgaatctatctgcatggggtgttctcctgatacacatacacaaatacccaccacagataatccatcaatcaacccataaggaatttctatgagatgtaagtgctgtgatagcgaactctcgtttgagactccagtcatcaataaacatactggtaaggaggacgatctctgctcctcttgccgtaggtttgctctcaatcctacactggatcatgagtattttggtggttggtatccaagcgaaggggttaccgctcctctccctaccggggactgacattgtatatagagtgcgcgtactctgacaatatgtataaatagtagattacggtgcgaataattctttaagggcttgacaacaggagatttcgtgctataatcggagtatatggggcttacaaagcttcagaggatttaatatgactcaagaaagaaacaagggcggtcgccctacgaatgccgagctagaagcccggggtatcattcagacagacctgaaagcagggcttagacttctaaagaagagctttgcagagaacatcagattcctccaagagcaatctgacaacccagaggtctctctacagatgagaatcaagctcaagaaagagctttctgacatgttcgtcgcttactacaaagctgacattgcactcaaaaaagagcttgcaaaaggaacagaatcaggagataatgagaactctgaagaggacaagactcccggagtcgttctcgcgttttgattaattgccgcttcgttcaatggtaggacgccagactttgaatctggagatgatggttcgatcccatcagcggctgccaaatgtagtaaaagaacattcacccgacaaggaatgtgtctcgctcagaggacagcgagtaataagtgtcctccagaattaagggtcggtgagcgtaattggcaacctactggattccaaatcctcgtattctctgttcgaatcggagtcggcccgccaaattagtgttgacaggagcaaagacctcttgtatagttacaccaactgctcgtatagtgtaatggacagcacaacggtcttctaagccgtaaggtctaggttcgaatcctagtatgagcgccaaattagatggacggaagctaaagtggataggcatcgggcttttaaggaggagatatgaagctgtgccctcgctgcacaatcgagaagccagttgaagacttctccagaaacaaaagaaagaaggatggtttacagacatactgtaaggaatgttattctgccatcaatgcagacacgtataagcgtctacctaaacgtaggtccaagatactacaatcgaacaaggatactattgcacgcaacagaaagttcttgggaaggttgagaagaatgtttggttgtaggttttgtggagagaatgagcctgttgctttagactttcaccacatcgaccaaacacaaaaagataccgaggtcgtgaagcttgtttcgtacagcagactcaggctgaaagaagagattagaaagtgtgccatcctgtgttcaaactgccacaggaagctgcatgctggtattgaaggatatgagattgtagtttagcgtctgcacacatgtctttttaagtcggattgcggtgagttcgagtctcacccgttcaaccaaatttagtgagtaaatcagataggttctgaggctccctgctaaggagtacgtctgctaacgcggatgtggatcgagaccactgctcactgccaaaataagtgattttaagtgttgacaaactgaatttttcatgttttaatacacttatcagatgaagaaacaattagcgagtagccctgagtaggtcgggaactagtctagaaaactaggccactgcgatgagcggtgagggttcaactcctttactcgctgccaaattaaggccctgtggtggaattggtatacacatcagtcttagaaactgacgccgagaggattgagggttcaagtccctccggggccaccaaattaagaatctcttttgctatttggttagggttcgagtccctacccggcgactatggccggtctatggcggccaaatagtgagagagctaggggacatgacgaaggtagcgctgctttccgatctccccggcgctataaaagttatcatgaaggggttgacaaacaagaaattcatgataatataggtacatagagtaacaaacaatgtagccgggtagctcaattggtagagcacccgaccgataatcgggtggttgaaggttcaagtccttctctggctaccagaatttaaaggcccattagctcagtctggactagagcaagcccctgtctagggcaaggtcgtcggttcgaatccgacatgggtcgccaacaaggtcgttgtagagatagatggctactatcatccggctgtaacccggacgccataggctagaggttcaattccttccttcgaccaccaaatagcgagagcgttaagactggctggcgctgtcactcggctcataaccgaacacaagtggttcgattccacctctcgctaccaaattgcactccgaggaaccctaagtggtgggttcagtgtcgctacctatctcggtaaggggaagcgcctaagctggcacgggtaattgagtagctgtgataagctactggcagccagtataaatcgtccggctcgggcccgttatagctcctagatttgaattagatgctgtaagccataggaggtgatccagtatctcccggaggggcccgggttaacaacctcatgaatttagcccgcgttggccgagaggtttaggcggcggattgcaaatccgtctcacatcggttcaaatccgatacgcggctccaaagtttattgggatgtagctcagtggtagagcagggagctgttaactctcaggtcgcaggttcgagccctgccgtcccagccaatttccaaaagagactcttcgctttagaagcagagtcgaacgcccgatacgggccttattatctcctcgtagctcagtctggttagagtgtcggatttggaatccgaaggtcgaaggttcaaatccttccggggtgaccaatttaaagcgggtttcgtatagtctggttattattcttggcttccacccaagagactagggttcgaatccctaagcccgcaccaaaagtcgtagacctcagtaacccggagtaacgcccgggagaagatgtgagttctacgtatacgcgtctgaagctaactaggtagaagcaccgggttgaaattccggaggacttggatcgttaccaagcgggcgcaccaaacaatgcagttatagattaaatggataaatcgccagactttcaatctggtgttccgggttcgatccccggtaactgctccaatcaagtccaagccggaacattcctccgtatgtgctttcagccggcttggcattatcagtgtggagattgtgcagcccggatgctgccttccggttgtgacccggttgttggggttcgagtccccgcctccaaccaatgttgtggaattgaatcacaggacgacgactgggtgagattgagcgtcctctagcccgaaagggtgttcgcgcaaggcgaaccgaagccgaaaggctgaagtggtgcccggacccacaaccaatgttgtgtaatggaactattacgttgacgctgtgtgctctccggatcgtaagccggtaaagcgggaatagcgggctcccgtagcagagtagtagtgtggttcgattccacagcacgacacctttcctcctcgcctgtgctgaacggtttcctcctcctttcccgtctcacaggctctattccctgccctttaagcatttatggtgatgcaccggctttgtaacccggcgaattctgttcaagtcaggaatggggcaccaattcactatcaaagaacccgcaagctcccgatagggttcacactctataaggttgtagcatggaaaacactaaggttcctgataaaaaactcggaccaatcgcgctagcgcttaaagaggccagagagaatttcgatctcagccctcatgttattggtccaaaatctttcaaacagaaggagttcacagacagcgatgcaaagatcactgtattcggtggtgctgctggtgctggtaagtcttatctcggtgtaatggacttcatgaaatatatccatgatcctaacttccgaggtgtaatgactcgtcgtactactcctcagattaaaggcccgggcggtctgcttgaaaaagcaacagacctattcaagctcgttgaccctaaagtcaagtggaaagacaaagacggcaagtttgtgttctcttctggtgcagttattttccttcgacacttcgaacaagaatctgacaaagactccttccaaggttgggaggttagtaagttcctagtcgacgaaggtcagcagttcacagaaggcatggtgacataccttatctctcgtatgcgtaacccgaaatgctcggttgttccgcacatgaagattacatgtaaccctgattacaattcgttccttcgtaaatggattgaatggtggctagaccctgacacaggaatcccgatccctgagcgctccggcgtaactcgctggtttgtacgcaaaggcggtaagatgttctggggagacaccaaggaagagtgcattgcccttcatggtaatcccagtctagcgcctgacgatgaagatcaggtgaagcctatcagcttcaaattcatcgcggctaactgtttcgataacccaatcttgatgctcaacgaccctgagtatgtagctaaccttgaagcccttcctagggtagaacgtgaaaagctcctagacggtagctggcacgctagagaagagggagctggatacttcacaagggactggtgccaaatcgttccccatccgcctctacgggtgcttaaaagggtacgtgcatgggacatcagcggtagcattgaatccgaaaccaacagaaaccccgactggacagccggcgtgctgatgagccgtacaaaagaaggcttgttcactgtcgaggatgttgtcagagagcgtaggttgttcggaggtgttttcgacctcattctagaaacagccaagcaagacggtcaagacgttgaaattcaaatcccatgtgacccgggggctgctggtaaagcttatgctgcacagctaattagagacctagcggatcatggattccacgccagaccgaagacaactaacaaatcgaaagttactcgattcgccccgttcgtatctgtagctgaaactaaatcagtgcaagtcgttgcgggagattggaacgaagattacttcgatgaacttgagcgattcgacggaagtaaggctatcaaagatgaccaagttgacgctacatcagatgcatttaatgctctatcccttggcagcttgattatccctgatttcctaccgcctgatatgactcaatccaacaaattcaaactaaattaataggaggcggcgatggccgagactgaaaagacagcaccgggtatcccgcgacttcgcctaggcgagattggtagtacaggccttaaacaagtcaatggtactattctggaagaacgccgaccagaacttcggttccctagggcatgcagaacattccaaatgatggcggaagaccctaccatcaaatcagcactcgatctcttcgaaatgatgatgagcagggttgactgggaagttgatctaggagttgaccccgacgaggctatgaaggcccggggtaaattcctgaaagagtgcatgcatgacatggaacacagttggtactccttcatcaaagaggtcactagcttctacacctacggattctccgtacatgaaatggtgtttaagcgacgtgaaggataccctgtatcgaagtacaatgacaacaaattcggtattaaaaagttgccaatccgctctcagtctactatcaccaaatggttgtactctgaagacggtagaaacttcctagggtgtgagcaaagtcttgccaatgttgtcaatggcgaccgttacgtcaacctaggtaataaggacggaactgtagagattccagctaagaagatgcttcttttccgggtcgatgctaaacgtgacagtcctgaaggtaacagccctctccgtgcgtgctataacgcttggagatatcgagtagagattgaagagcaagagtccgttggcgtaacacgcgatatgaacggtatgcctacgctctatctgcctcctcgatatatgtccgaagatgctacagaagctgagagggcagtctacgaatactacaagcgagtaattcgtaacattcaaatgaatgaacaatctggacttatccttcctcaagcgtttgacccagaaagccgacaacctctgttcaaattcgaactgacctcttcgcagggcagtaagatgtatgatacagatgccatcattcgtcgctgggacaacaaaattctgcaagccttgtttgccgatatgctgaagatgggtcaggaccaagttggctcttactctctagctggtgccaagactaacatcatggctatggcgattgaatcgcggctccgcgaaatcaaagacgtactagataataaactcattcctacgctgttcgcactgaacggtgattatagtccagacttgccgaagctgcaatacggcgagctagatgaaatcgatcttgaagagttctcgaaagggattcagagaatcggttctgtcggtggtcttgaacgtgaccgtgaggtttacaacaagattcgcaaagctctcaagattaagcctcgaccagacgacgagcctgttgatgtggataatatcatgggtggtcagtctcaagcaggtaaagctggagtaggtaatggtgcatcaacatccgcagccggtagagacaacgccgctgcaaataacgcataaggagacagaatgctgactcttgaaagtgttattgaagctctcagcaatgctttcggggctcccgccaaggcggaagaagccccggctgtagaggtcacaaagtccctagacaatgaaaagaggatggctttgtttgtcgttcttgagccccaagaaggcgactccacgactgacctacacgcagacacctactccgaagaggaagtagagaaagcttgcatcaacttcaatactcattgcaacgtagctaatatcttccacaagattgaaacacaggaagctgagattgtccagtccttcatcgctccatccgcattcacaactgacgacggaagagagatcaagaaaggtacatggctccagtggtggcacttccctgaaggctctgaagtagccgatgcactatgggaaggcgttaaatctggtgaattcacaggcgtctctatcggtgccagagctacagtcgaggatatcgaatgaccgtaaaagcaaaacgtaaactgaccgatatcaagtttgaacacgaaggtgctcatgtcgctctggtcagtaagctccaaggtggtgcagccaacgggcacactactctaatcacaaaagctaccaatggcgtaactgaagagcttatcgataaagctgctgaagttacagtcacaatgcagttccctgagttccttcgtaagttcttcgggatgtattatgaagatgccgaagttctctctgttgccatgggatatggcagaacggagtatccagaactagatcacaaagactggatcgaccagcgggtcgagtctatgtccattcttaagtcggtttataaatcggctgacctgaatcaagctctctccgagcttacccctgagcagaccctttcccttaaacaggatcaggaactgcttgaaaaggctctggaggtagtctccgagcaatccaatgaaaatccatccaaggagattaccaacatggaaactatcctgaaatcggcccacctagaagctctagctgacgctattgcagttgaaaaagctgctggtgtcgctgctgttgcagaagttcagaagcaactagacgccgctaatgtagagcttacagctcttcgtgaaattgtcaaggctgctgaggcagagaaaaccgctgctatcgctaaagcccgtaaagagcaactggctgaagtcctcccggctgaccaagtagaagatactttcaagtctctggaagttctggacgatcaagcttttgcacaaacagtaggaacgctccgcattcttaaagctgctgctgaccaaaatgacatgcttgtcgagaaaggtgtatcgggcgctggggaagaagacgactctgttgtcgccggtgttgccgctatcctgaaagctcgccacggctccaagtaatatctagccaatctagaggaattccaaatggctcaaaacattatcgcaaaagatcatcagcgtcttagcaactggctgaaagaagaacaaatgggccaccgtggcctgttctacactcgcgaaactctgcctgtcgctgacattgatgttaaaacaactggttctgtcctagacagcactggcaagctggtaactaaggctactatcgccgacgctacctacatcctaattaccgacctgcacgactatgccaacgctcagatgagccacgctgtcgtccttgctcgcggttttgccaagatcggctccaaggctgttatcttcggtgctgacgttgacgacgctgataaagctaccgtctttgaagctttcaaagccaagaacatcttcgccgttgaccagatcgaaggcgcattcgagaacgtcaccttcgcgtaagcgagggtcgttccagtaaataaacactaggagtaactttaaaatggctaacacccgttcctacctaaacgatggtcagttctacattgccgaccagactgaaaacctgcttatcatcccgaacacttggaccctcgtcgagaacatgggcgtcttcacaagtgaaggtgtgactcagaacactgtccagttcgaagagatcgaaactcgctacggtctggttaaggatgccatccgtggaactcgtcaccaagttgctagcgaccaacgtcgtcaactgcgtgccttcgcgattccgcacttcaaccaagacgactacatcactccagaagacattcaaggcaagcgcgctttcggtgctgaccgcgaagaaactctgaacgaggttcgtgctcgtaagctggaaaccatccgtcgcaactgggctaacaccgctgaagttgcttccgttagcgctatcgtaacaggtaagagctacgccccagccggaaccatcgagtacgactggtacgacctgatgggtaaaactcgtaaggttgtcggcttcgacctgaccaaccctaccgctgacgttatgggcaagaccgaagaaatcttcgtccatatgcaagacaacagccaagacggtctgatccgtggtgacttcgttgccctgtgctctcctgagttcttcactgccctgattaaccatccgagcatcaaagagttctacaaagcttaccaagctagtcctcaatactggcgtgaacgtctaaccgctcgcggtctggaccttcgcttccgtgagttctacttcggaaacattcacttcatcgaataccgtggcgttgacccgtacggcaaccgtctgatcccggctggcgatgcttacttcatcccaaccgacagcggtgacctgttcgctcgttacttcggcccgggcagcactttcgatgacctaggaactctgggtaaagaactgtacgctaccgagcgtatggctgaagaccgtcgttcgatcctgatcgaaaccgagtccaacttcatccacgttctacgtcgtccacagatgatcgttcgcggcactgtgaatgcgtaaagacttcagggaggcttcggcctccctttcgtcgtaggagggtaccaaaatggcttacactggtgatccagcaaacaaccctatcgaccgtctacgagagattgtaggggacgtgtgggagcctccgatgctttccgacgaaacctatcaatgggtgttggacaagaacgaaggcaacgaaagacgagccgcacttgaacttatgcgtatgatgctcttccgcctgacaaggggaatgagagaacgcacaggtgatatcgaagtatatggtgctgagtatttcaacaactacttgaaagctcttcagctcattctcaaagacccgaatattgcaatttctttggccgtgccatatgctggcggtatctccaaatcggatatgctggctaatgacctagaccccgacaacgtaacacgggaattctacatcggttttgcaagacgggagaagctttacaaccagtgcaaccccggtcctcaagaccttagcatggggtgtgattatcttggcaagcttcagttttaaaacagatcgccgtcgcctcacatccttgattaagagggtggaggctctagacggaacaacggtagaagttggtttcttccccgaggaccgatatggttctgaaaatggaaacctaccagttgcacaagttgcagcttacaacgaattcggtactactcgcaacccaacccggccattcatggctccaacctttgaagaattcacatctcaattccactacgcaagactaatgaagtccacgttcgagaacgtcctacgcgatggaaggcagacgaatactcttctgaagaaattgggtaaaatggttgcagagcagatgcaagttaacattgacgactatccgggctctaacagtccggcatgggcagcttacaaaggatttaacgatcctctattccatactggaaagatgcttgagtctgtcaagttccaaatccatcggaggcaataatgctctatcctaccttctccatgaccaacttcgtaaagctagatttgattagaagagggcagcccggagacgacggttttggaagacctacccctccagttgagacagtagtaacaatcacagctaacgttcaacctatcgaaaaatcgacagacactcgtatccttccagaggccgacagaagcaaggcttgcttcaaggtgtactccagaggcgaagagattcgacagttaaaggaaggcccgggagggtggagtgccgatagattcatgtgggaaggagagttgtatgaagttatgaaagtcatcaactattcgatgggaatcctaaaccattacaaagcaatttgtatgagagtagagaggaatagcacagcatgatccacacagagctagaaaactccctctatcttatggtcaaagagttgttccccgactggcgtgtaattcaagcttacacgaataatcaggaaccgcaaaccccttatctggctatcgacattaagaggctggatgaactgggaagggaaaatgtctccaatatgagcgatcccattagtccttcgcatggaactattcaagttcaacaggacttcgcagccaaagtcgtattcgaactgattggcaagtatggagagacagcaagtgtctctgacatggcaatggcgattactcgggcaatgcgtactccagcaggacacgccgcccaaagaaagtttaatctatcccttttcaaactccctagcacaagacgagttcctatgctaagagaaacagatatgtacatgttctatcaagttacatgtgaatttggattctctgttatagaaaccacaactcaagagtttgctgctggggctgatattcacggcgtttattacgacgctggtcgcccgggtcacattattgagtcccacatcgacataaacttcgaacactaataggagacaggaatgactgttcttactgatgtaattgacattcagatcagccgtgagactgctgctgtcgcacagacaaacttcaacgttcctctgttcatcgcttctcacacaaacttctcggaacgtgccagagtctacaacagcctgaaaggtgtcgctgaagacttcggagaatccgatccaacatatcttgccgctgttcgctacttcggtcaagctctcaagcctcgcagtctagttatcggacgcagacaagttccttctgctaccgtctctgtcagtgttgttcaggaaggacaaagctacgtccttaccgttaacggactacctgtcagctatgttagccagcaagacgacactgctactctgattgccacaggcctaaaggcagcttatgacgtaactccggtagccggcgtaaccgtcacagacaacgaagacggaactctaaccgtcgcttctaacgaagactggagcctgaaggtttcttctaacctgactatggctgctgctccctctactgaaggttggccggctgctatcacagcagttcaaggagaaaacgacgaatggtatgctctgagcattgacagccacgccgatgatgatatcatggcagtagctactcatatcgagggcaccaagaaagtgtttatcggagccactgctcaggctaacaccaagacttccgcagagaatgacattgcttctcgtctggttgctgccgggttccaacgtacggctctaatttaccatccaaacgctgacgctcaattccctgagtgtgcttgggtaggataccaactgcaagagcaaccgggtagcaacacatggacccataaagctctagctgccgtagatgcttaccgtctaaccccaaccgaatctaccaacctgaagaacaagaacgttaccacgttcgagcgcgttggtggtgtcaaccgtacattcggtggcgctatggccggtggtgaatggatcgacgtaatgattttcgtggactggctggaagcccgcatgaccgagcgtctgtggttccgtatggctaactccaagaaaatcccttacgacgccgttggtgcaacaattctggaatcggaaatcagagcccagcttaacgaaggaattcgtgttggtggtctggctgaagctccggctcctaaagtcttcgtacctgatgttctatccatgtctccgaacatgagagcacagcgtatctttgaaggcattgaatttgaagcccgtctggccggtgccattcacttcgttcacattcgtggaactgtgaccgtctaaggacggtccttcccataaggagattactaaatggctgttcaacgtctagcgacattctctccggctgatgttaccattgttattactcaccctgcaactggtgagagcatggttctcggcggattcagcgaagacagtatcgttaacattgaaagaaacgctgacacttacgtgatgtataccggagccgacaacacatcgactcgcgtctacaacgcctctaagtctgctaccctcactgttagccttcaacaaacttcgccttcgaacgacttcctgactgctctttacaactacgacgacgcccgtcgttcgtctgagggattgttcacaatccacgttaaagacaactctggtcgttccgactacttcagtgatgacgcctatgtcggtgttgttccgggttctaacttctcgaacagcatgcagacacgcgattgggttattcatgcacacaacctgcaaactctaatcggcggtaacgccaagctgagcccgggtgatgcggatactcttcgtaacctaggtgtcacactagaccagcgctggctgtaatatagcgcttatgccacatcgacggggagctgccttaacgggtggctccctttgttgtttctggaggatagaaattgattaccacctactcgccgcgtgacgtggttgtaactctcgctggtatccattccgtgacagggtacgcagagggagagtttatcagaattgtaaaagatattaagcctttcatcaagcacggttcgatggatggtgaaatcgcaagggtctacaacaaagaccaaggctggcgagtagagttgacaatcatgcagtcctcgccgaccaatgatatcctttcgatgctttacaacgtggacattgcaacccgaatgggaaaattcccactgatgattaaggacacgaagggttctacaagcttcctagctctgacagcatgggtggaagacctacctagggtatctttctctggacaactggagacccgcacttggattctagggtgctctgaggtcgccatgaacattggcggaaacgtcgatcaaagtttggtcgagcaagctatcctgctgggaagctctcttctgccagcccttacgcaattcggaggcttctaatggctaacacggtattgacatatagcccatctgatgttaaaattgtcctttgtgggtatgctctcactggtgtagtttctttcgaaatgtcttggctttcgagaccctacacaatggttcgaggaatcagagggcaccacacccgggtcttcaatagagacctttctgcgcagattagaatcgaggttcttcagacttcggtgtctaatgatgcattcttctcgctagtagagcaagaccgaagaacacaatccgcccgaatcaccttgtctgtcaaggatacccacggtagcaccatgatgagcacagacaacgcttatgtcaatggctaccctagcataacattcaccgatggaatcgagaacagggtctggactattgatgttctggactggaccgatggcacggtaggcggaaaccagcaagtcggcttcgacgtgtttggaactgttcaaggcgctcttagctacctcagataaataaggagtatttatgttcggaaaccaacgtactgtcatccacaatgggacagaatacactatcaaccttctgccagcaactcgcggtatcagcgtactgaagcagctaaccagcttgctgggtccatcccttgccaagtatcaagctgaccacgacttctctggagccatgaaagaactgttcgataacatcgacaaggttcctgttgagaatttgatccagaatctgatgctgacagttttcaaaggttcgatggcaatcaatttcgacaccgaattcgctggcaagtatgacctgctgtacgcactcacaaaagacgtgatcgagttcaacttcggctcggttttttctctaatcggtttcgcagaggcaccgacggtataaagaccggggatgggcagtccgagacttcagtcactactgatcgagttcagagtgatcggagggttagggaggcccaccagaagttctcgcagcattgggagatttatgtggctatcactcaccctctcaagctaacgacgtatggggaactgagtacagtcctcactacagaagatttgtacaacatccttgaggttatagacgttcacgatactatcactcaagtggcaaaagaacacgcagaggctgataagaaatgattacagaaaggattgcccagctaactggggaacttaaatttacagtcgattcccggcctctcactgcttttgacaagaagctcgctggggtcgaagcccggctaagagaattctccaagctgacgaacaagcggtttggagttaagctaactctagatacaaaaactctgagagaggagcttgccaaggcagccactcaaagggtagtcttgaagaacatcgcggtagatgctgccgctgttcgtcttatctctgagaagcttcaagaaagactgaatgcaacgccgatcaggttgaagtctgttaggctagaccttagcggtatccgagatcagaaaaacttcgtaaagacggctctcggccagaccaaggtcgatctaccggttgaactgggcttggctcaggctagccgtacgctgtatgaatggaagaagcgcacagagagtcgttttaaaattcatctgaatgcagacattagccgctctaaattgctccagaatgcacgaaacacactaagggatgtgcagggtaggctaaacggtcttgctgtcgctacgcctcaaattaggctgtctgtagaccgtgcccatcttcgtagagagattcaagatgttcttgagcaaatcagacgcgaagtgagaatccgcattgacctagagtcttccatccgaggaggtggtgcaggtggatcgagaggtactgccggccatatccgtcaaggtatgggaatggggattggtagcgagctagccgggtggggacgcgggtttattcccggccttggtggtgcgttcgctattatgcagcttaaccgtgctaaccaagaactgcaaggtcaacgtctggccatgcaagctgtcggtggtggagtacagggtggtcaagagctacaagccaccctccgcgatatctctcagcgtctcggtcttgacgatagagcaataggtagctcctatgttaagatgatggctgccggacaagcatccaacttcgacaaaacacaggttgatggcatcttccaatccatggctgaatatggacgagtgatgggtctggacggggaggctatgaaaggctccttccgtgccgtagagcagatgatgggtaaaggacagatcatgtccgaagaattgaaaggtcagttggccgaaagattccccgctgctgtagctctgatggctaagtctcaagacatgactatcgcagagctaatgaaaaccatggagaaaggggagcttaagagtgatgctctgatcccattcgccagaactctagcggaagaagctcgtaaaggtggcgctctggacgcggctatgcaaggtacagccgctcagcagggccgattccagttcggatggaaccgcactatcgaggccttcgcggctggaggattcgaccgaggaatgagcgacttcttcaagattgctgcccaaggcatgaaagaagcgcttcctctggtaactgcacttggtggcgggttcgaagctcttatgaggcctgtcaacgctctggtcggtattggaggggagcttggttcccagtgggagaacattgccaagcagttcaacatgaccggcacagggctgactcttaccacggctcaaaccctagccttgctgacccctatgggcaggttgatctctgctattagctggggtgcgttggcactggaagacttcattgtcttcttggaaggcggtgattcggtgttcggggacttcttgaacaacaacgtacaagctgccgagacattcgaaaagctagccagtgaatccagtgaactgaagaacaatctcgacggtatcttctctgttgtcccggggctagctgaagcgctcaaaggtctagagttcaatgaaatgctggtcagcacgatgagagaacttgctgccatcatggagttcttcaacagtgttgtagagagattcgcaatagccggcaagtacagggacgctaagattgctgaagccggaggagacagaagtactataatgtcgaacatcgacacgatgtacgctatgttcaatccggaagatgcaaaagacaaggccaccttcatcggtgacaggctagtagctcagaacattgacgcgatccagacagagactcatacccgtgcaacccagtccttgactccagaccagtttgggtatatgatgcaacgtggtcaagttagaaacgaaatggagggtgccctcaagaagagtgccattgacattagtttcaacctcaatgtttctggtatcgatgctcagggtaacgtcatgacaactgaagcgcaagagcgagtacgagagatcgttagtaacgttcttgaggaagaaatctccagagcttcggcaagttataaggaatcccaatgacaattgctatcaaaagagagaacggagacctaatctggttcgacgctgttacagagttcggaagacagtaccgtggctctgtgagttccaacccaatcgaaacgggaggaaaaatcacagaccacattactacagaaaacccagtcttcactcttacagccgtcgtatcagacgcagacttcaacttgaacaggcccgttatcaacgacaacgaggcccagacatacaagatcaacaacaaagagttcgtgaatacgcagccggtaaccatcccggctgttatctcaacctctagactagaccctagcagaatctttccagaagttatcactcagtttattcctcctgagattccttctgcaactgtcctccctcaaaagggtgataaagtcgcttatgatattgagcgccaactgatcgacatgcagcgtaatgctgaggtcttcagtttgctggacttccgagacggtatcatctgggatcaaatcgaaagatgcatcttcaccgacttgtctttcactgaaaacgccgagacaggtagcagccttcaacctcgtatgacaatcgaggctgtgacattcacagatactcgttatgtcgaggtgagggttaacaagggtagaaagaccgctaagaaagaaaagagagacaccaaagaaggtgataccggggctagcaatgctaccagccaagactctcctacattcaagcgtagtcaaatgaaagaggctcagattagaactcaggttgcgaggtagactaaatgagcacgacttatatcgacacacttcctctctaccaagaccggaagtacagatacgcagtagctatcgagggaatctcaagagtccttcaattctactggaatagccgctctcggcagtggcacatggatatattcgacgaggaacttaaccctatcctgacaggactggcggttgttcctcagtatccgatcatggcagactacgccatgcaacatataggtttcaatggctacttcctactgatgcctgtcaacctagaacaggtacagtataagcacgatgcaagtgacattgtaccacagtttttcgaactgctatacgtgaacgttgacttggaggatgacgtagagtgaaacaatatgacagagtgtataaactaacgctcggtaacactgaatccgggcaaggtgtagagattacaaacctccaccctgacggaagtttgaacagagagggacttcagttccggtttgatatctctaaaagttcagataacaagaagagcggaaactcggcgactgttgagatatacaatctgtctattgccactctgaacattcttgaaactgagtatctgacgtgccgactagaagttggttataaggaaatgggaacttctgttgtgcttgatggcaacgtggttgaaacttcgactagaaagagtggtaacgattatgtcactcagcttattctaggtgaaggatatacagcactaacagagaccaagctgaagggcacagtatctccgggcaaaactgtaaaggatgttatcgaagaaattcgtcttcaaatgccgggagtggacagaggagcttatacaggcctcaattgcaacaacccgatcatgtatggataccaactacgtggactggctaaagacgcactaaacagtgtgtgtgaagccaacaatattgaatggaacatcagtggaaacgttctaaacgtcacagacgttaacggcccaacaacgaagagtgttcaaatggctcctctcgtaaacagagagaccggcctgattgatatcccattctacgccagtgccagcggaacagcacagaagaaagaccagcggagacggaggggcgttcaattcaaatgccttctcaaccctgagctaactcccggggttcttgtccgggtagagtcggacagattgtcaggcactttcagaatcaacaacgtccgaatctcgggcggatacagagacaacgaatggtacactgaatgctggtgttccgatcttaaccaagaggatattgaccaatgaggagaacaggcctacaagagcttctgaacctgcactcgtccacagagggttcgaagcagtacactgccataccttgtgtggtattgcgcgttctggacgattttagacgcctatctgtcgatgttagaccagtggtcaacgacctgtacaaagacggcacatcggaagagcaaccagagattctatctgtccctgtcattatgccgggaacagctaacacacttatcagcttcccattgaatgttggggatacggtgttgtgtgtattctctcaaagaactatggacgtgtttaaaggctctgccactggacagccacacactccaaacgatcttcgtaagttcaacatggcggatgccattgccattcccgggctgttcaccttccctaggtcgatgaacgaccctgcaagacatagttggccacatgataccaaagaccttactattgcccacaacctgatgacgggacaagaggcggaagttaggatcaaagccaatggagatattctaatcaacagccgcaagactataagcattaatgctcaaaatgtcaacgtcaagtgtgcttcactcactgtcgatgcagcccatacaacatggaacgggaacattgcacatacaggtaactacgtgcagactggtggaacttctacattcaacggtattccattccacactcacaaacacggtggtgttatgccgggcggcggtgttactgctgtcccacaagcttaaaggagatcatatggacttgtttgtcaaccccgacacacatgacttggtttttataaatggtgaagctccagtcactcaacgaatggttgatattgttgctcagcgactaaagatcaaactgtacacattcctaggtgagtggttcttggatgataggatcggcatcccctacttcgagaggattcttggtaagtctaggagccttcccgctgttgacgcgatattccaatctgagattatgagagaccccggcgtccttgagattacatcttggcagtcggggatcgaccctcacacacgtgaatactccatggagttcacagtcagaaccacagacaatacagaatcccttcccatcactttcagaatgataggagtttaatatggctggaattacagcagaaggtctaacgattaaagacttggaccaaatcctgacagactacagaaacgtagcctctcaggtcttcgccgacctagtttcaactggagacgaagttgacacgtctggtaactctgctctaggccgtctgatcggcgtagttgctccatcggacgaagctatctgggaagttatccagatggtgtataactccttcaacccggcagccgcaactggcgtggctctggataacctagtatccttctcggcaattagccggcatgctgcacgtccgacccgggctcaggttgttctagagggcaacatcaacaccgttattaactcgcctcccgcgaagatgatttccagcagtacaggccgagtgttccacctactacaaggcgtgatcctcactcctaaagcttgctctggtgttggaatcttccctcagacagtaggcaacgacctgacgtacgagcttaagatgtacgttgatgacattaacacaacgtctatcaagtacacaagtcctgccactggcacagtaacatccgagtccatcctagcaggactggccgccgacgtagctacaaatcacggaaataccttgacaagctacgaacagaatggtatacttttcatagtacctattgacccatttaacaccaagactttcgaagaagcctccaacctgagtattcagaaggttagaaagcttggtatcgctgttgacgacgttattggccctgtgcctcagcaagctctagctatcgatacgatctccattcctattgccggatgggacagcgttatcaaccctgttccagctatcactggccgtctgcgtgagaccgacgatgagcttcgcgagagattccgaaactctaaattcgtacaagccaccaacattctggagtccctaatcgacgggctgatgaacgtagaaggagtcgaggatgttaggattatcgaaaacgatacagacaacccagacccagttcatggagtcccgggtcactcgttccttccaatcgttcttggcggtattcctacagaggttgcacagtctatttggctgaacaagccattcgggattggctctgttggagatacagaggttcaggtggtagacagtcggggatatacccatagagtcaactaccagcgccctgtcgaggttccaatcgagatcaagatcagtgtaacaaacacaggatcgatgccagagaacattgaagatatcctacggccaaggattgtagcgtacgggaccgagaattacaagatcggagacgatgtaatttattctcgattctatgctccaatcatggaaatcccgggcttccaagttaacagcctgacgattgccaagaaaggacaaactcaaggcatggcgaacattgaaatcgggttcaaagaagtggctacattcgccgcagcagatatcaccgtaactacggtgtaatgatagaaggagaattccatggctgtcaaccaatttgacagagaagattatctggaggtggcccgggaacgggtcactgaacagtttaaagagaagccgatctttgatcgcttcctgcaagtgctattgtctggcaagtttgatatccagaatgcactggaagacctccagactctccggtctctggacacagccaccgggaagcaactggacattatcggagacattgtagggcgaccacgcggtctagtgtaccaagatattttcaactattttggattcgctggaacggagcgtgcaggttctttcggaagcctgtcggaccctacggtcggtgctccatggtactcggtcggtgctccaactggtaacgccagagagccgagcgacgaagagtatcggatgatcctgaaagcaaagatcatcaagaacagaacaaactcaaccccagagcaagttatcgaagcttataaatttgtattcggggttcctgaagtattcctagaggagtacgctcccgctgctgtccgtatcggcatcggtaagattctaacgaacgtagagcgtagtcttctattcgacctaggtggtgcaggtgcattgcttcctaagactatcggggttaactacacatacactgagttccaagctggccgggtatttgctacagaaggcttccccggaggacaaggcgttggagacctaaacgatcccactgttggtggaattctgaccaacctagtgacataaggagttataaatggctgattacagtcaactacctattgaaaatatttggtccacaggcggggatatggtagccccgacccctgcgcagcagcaaggcggatggggtattcagtcggttcctcgccaatggtggaactggaagtggaaccttcacgatactaacctagcgtatttgctacagaagggcatcccagagtggactagtacacaagagtacattgctaacaaatcgttctgcactagaggtggatttgtttacaaggctgttcgtacgcatacaggaagcgaccctgcacaagttagtgccaactgggttcgagcttttgcagattacaccacatctagctctgcacttggaagcctgacaccaagagagggtggaatcccattcttcattagcgctacaggagctagcgtgtttgactctacggcctatggtcgcggaatgttgaatgtagctaatgcctccgcagctagaagctacatttcggctcaagaaagctctgttgtactgtccaacctgtccactgtgactagggctgccaacacggttccgtacttcaacacggatacctccatggctaccttcaacatcacagcgttcggaagaggacttgtcaacgcggctaatgatgaaaacgcaagaaatttcctaggactagctaactctgctatcattacggcagacccagctaacagggcacatactctggtctatagagatgctgctggcaacttcaacgctggcgtaatcactgctaccctgtctggaaacgcaactacagctaacaagcttagaaccccagttacaatcaacggtgtggcgtttgacggaagccaaaacattgttcttccgggcctagatacaagttatgcgggaacggttgcacgtcttcacatcaacggagcgaacctttcgagtgcagataagactactcagctagcactgaggaacaaatctgacaacgactggattagccttgctgtagtggatgacaacattctccagtttgtattcagaagcgctacaaacccagttgtacagattggcaacgaagttatccttcacacaggaaaccagttctctctgggcccgactcttacagacgctaggtctcgtctgggtctcgacagactaactcaaggtagctctgatactcaagtcttccccagcaccttgaacaatggcccctacttgaccgtacaacctacggctatcggaggattcaacggtagcactaacggatggctgttccgattcgacgctaatggtaacatgactcatggtacagttcctgccgctagaatcactggtctgtccaactcggctcagattccagccacaactacggcgcaggctaactctcttgttcagagagacgcagacggaggattcagcgctattgcgattaatgcgtatggcactatcgtcgggtacggctctaacatcttcagtagagcatcgggcactggcaacgcccacatcgggttccagagagcgaacggaacagaactcggtcttatctggggagcccaatctaacaactcgatgaacttccgagttgctggcggagccaccgcagtgtcgattaccggtctggacatgactgttactggaagagtcaatgctaccacactaaacgcctctggaaacgtgaatgcgacaggcaacgttaacgccgggagcgctacgctcaatacagcagggaatatcacaggagccgcttacggagcctatggttctctgaccaactgggttgattcggtatatgccaagaagggagaaattcctaacgatatcgcaagagccggagccgcttgggacgctgtaggtcagtatattctggcgggagatcaatctggagggtctggtggaccggggacaactagagctggaagccagttgaagccttattcgactattagctacacagcaggggcactaccagcagcaggcacttacagatgtatgggagcgtttgcaggtggtggtaaccagattaccctgtggcagagaatttcttaatagagggcttcggccctccttttagaggagattatagtggaattcagaaatgttgtaaaatacaaaatggggttcgaatgcgaggtaaatcatcctcagtggggatggattccgttctacgcttgtgattacgacgatagagccaaactggtatatgacgccatcgcccgtgctgtcgataacggagaaatccccgaaccaaaggacgttacagatagagacctcgttgtagatgcacgtctgtggagagataatgagctaacccgggctgatcgtcaagtagaaattgctatcgacgatgaagacgaagtaaaagagaaggcttggcgtaagtaccgctctgcactacgtaagtggcctgagcataaaaacttcccagccgagaagagtaaacccaaagctccgaaggagtgaggtaagataatatgccaaacattatgaagcctacgggaatcaacgctatctggtctgaaaatggccagaaggttgacccgggtgctgtgaaagtagggctaggctgggttacggaacttcctccgtaccagactgcaaacttcattgaatataaacaagacctgtttaacgctcacgtcaaccaacatggtatccctgaatgggatagcgtgacagagtatcagggtaacctgagctacactcaaggcgctaacgggatcatctataagtgccttagaacccattccgacaagattccaactgaccctctgaacattacagccggatattggcgagtggcgtttgaggatgcgggagaggcagctaaggttcaagccaaccttgatcggcatgtaacaaactacaacaccctctctgggattggcaacgtagttattgcaagacaaaacctaagtgtgtatagtaaagctgaaggcgacgcccggtacgctatgaagcacgggaacggctctaatgttttcagcgtcgccactgccacacagccaactcacgcgatcccgctgagccagctatcgactctcgttcctcctgcgaccgagactgtagccggggttatggcagttgctacgactatcgagacagaagctggagccaatgataccaaggctgtgagtccgctcaaggccgcacaggtgtatctgaagaagaaagacaacctttccggtctgtctaacgtcactgccgcaagagctaatctaggactgtcggatacagcgactatgccttcttctacattcctgaaggcaggtagcaatctggcagatgtgcctaacaaggcgctggcaagatcgaatcttggaattacaagtagtgctacccagccggaaacctatttcttgaggagcgctcagaacctagcagatgtacctaacaaggcacaagctagagtcaacctaggcctcactgggatggctacaacagaccctgcggcggttatgatgaaggcagacaaccttgctggattggctaacactgctaccgctcggtccaacctagggctaggcacagcttctactagaaatacaggagacttcctgtcgtctggggataacctgtccgacctcacgaatgtccaagcagctagaaacaacctagggttgaagggagcggctacgctcgatgtatggggtcttcctgcgaatacaactgccatggacttccagtctaatcagtcggatatttccagaggatgggctcgactaccaaacggccttctgctacaatggggaactggtcccggtctatctgatgacacaaggacgaatatccaactccctgttccagcacgaatcttgaacgttcaagtgaccgtaatggggacgtttaacaactccatcggcccgggcgctttcatgacggatatgtggagcaacaccgggtttagagttagctgcaactggggcaactggtcttacccgttcaactggtttgctatcacttccaccctgtaattcaggagtatcaaaaatggctctaactgagcaagacttccaatcggctgccgatgatctcggagtcgatgttgccagtgtaaaggccgtcactaaagtagagagtcgtgggagcggctttctactttctggcgtccctaagattctattcgaaaggcactggatgttcaagcttctcaaaaggaagctaggtcgtgaccctgaaataaacgacgtttgcaaccctaaagctggaggatacctcggcggacaagcggagcacgaacgtctagataaagcagtcaaaatggatagagactgcgcacttcaaagtgcctcttggggcctattccagattatgggattccattgggaggcactaggttatgcgagtgttcaggcatttgtcaatgcccagtacgctagcgagggatcgcaactaaacacttttgtgcgcttcatcaagaccaacccggcaattcacaaagctttaaagtctaaggactgggcagaattcgcaagaaggtataacgggccggattacaagaaaaacaactacgatgttaagctagcagaagcctatcaatccttcaagtaaatctaggaaggttcctaatgaagaagctattcaaaagctggaagttctgggctgctgtaggctctgcaacttttatggctctggaagccatggttcatctttgggagcctatccttcctcccggcgtgttcgccgcagtagccacactggtagctgttggtgtgagaatttcggcagtgtttgtaactgctggtaaagtggaggaagcgatttcggaaaccatggaacatgacaccatagaagatggctcaatagaaaatgatactaactaaactcaaaaactacgccctcgtagtagctgccgcaatggcagcagggtttggatatctgtcgttctctttgtacggcgacttagctgttgcgaagaatgatatccaatctcttcaagctgcgtctcgacagatggaagagcagttccagaaagagcgagcagggtgtgagatcaccactgggagactagaggcgcatatagtccaaatgaagagccgacaggagcttctacaaggccacctgtgcgagcttgagtctctacctaacccaaccccaagggagacccaagaaaatgccacagagacgatctctgagccttctactggggatagtctggaccctgctcttacaagcttgctcgacagggccttctgttccgcagtaccaaacgatccttattgtgcccccggcaagcctgaccgaggaggttaaggtataccgagtggagcaagatacagtcaaggggctcgctagagcttacattctaaatactaacagtgctgccatgtgcaatagtcaactacagacaataaagctatgggcagaagagcagagggctctatatggaaagtaaagacggcaaagaaggcctaatcaaggtagctacacagggagttatctctctgctaattgctatcctaatggcttggtctggattcctaagttccagtctttctaagcaggaagaacgtatctttgcgatgcaaagagatatggtatccgaggcaaaacttaacgcactagagtcgagattcaatagccgacttgaaagtgaaattagtaacgtaagaagagaacaacaagaaaccaaccggtatttgattttgattatgaatgccgtcaagggtcgggatacagaaactcaataactataacccgttaacccacactgggagacaatataatgacaaggaaacaagactggccgctagtttcagcagtcggggctttgtttatctccctccttgtctgtatggctattctggctttcacagcgatgactcccgaggctcggtttgactctgtacgccagacctacgagattcgaattagcgaatctgagcggcggtatgaactcaaactgaacagactacaggatcagataaactcggcctcgtacacacaggatcggcaatcccgtttgcaatatgaagaactcgactcgcttaaaaggaagattagcgaacttgagcggagaataaaagaaaaacaagaataattaagccccgggagcgaaagcttaccggggctctttgtcatgggttttcagcgaacaacttgataaacttcatcgaacaggtcatcaagcttctggataaccttcttagccagcttcttgcgaactttgttagcctctgggctggaatggagtagcttaatatcggacgcgttgccccagtccatcgccccgttgtcgaacagcactttaacattcagatgcatcgagccctcgtcaatatcgacaactacgccggtcatccgagcgttggtcttttcgaaggtcggcctcggaatgtctatgtccagactgccaaccataacaacctgccctttcttaacgtcaaataattccatttaaaacctccttaatctaacttcattagtgtgttgaactgatgcctcagagacttaaaagcctgtggcccatcgtcttccgctccttcatgaatatgatgagcgattaagtgtatcaatcctcggtctcctagtaacaaagaactaggaatttcttttatccaagccacaaagcaacagaagtgtagaacctccggcatggaagccttgaagctggaatcatccagcttcgataggcgttcatacgtagctttaagatcgggatagcttaactgatatgtagcatcttcgtcaatatgctggtcccctctaactacatactgcaagctcatattacaccttctttccgccttctgcaagacgtgcctctcgcttatggtcggaacgggtcatattgtactcgatcttctcgatgatcgcacctgcaacatctagacctcgaacattcgcgtagtccatgatacgaatgatagcgtcagccagttccacctcttccatcttccgctctggcaagtgatcgtccatcaaatccttacggactccttcagccgcttcggcgatttcagtggtaacgagcatcagcatgtgcagagcatcacgtttaatcggctcgcctgtgaccagatcggtgttccacttgcggttaacaacctcaaggccagtcatcattttgttaaaaccgctaacaaactcgaagacggactctcgttcgaatagttcaccgaacgttggctcttgatcttcgacaattgcagtgtggaaaggccactccatccaagcgtcatagcactttttgataagctcttgttcgtcaatgtatgagaagaaatcttcatatccatcaatcgcattaacaacttcagttcccctttcccaattgcgcttatcaataagtctctggtcgattcgcagggaagtgctgccaacttcttcccatgatctccagcctactatgccatcgccgaagtacaacagaatgggcagattgaatccgcgttcttcctgatccttagtctccatagctataacaaacgccggtactttttctccacttacgccattggccaagacgaaagaacccaagtgggtggtctctcggctagctgggcgatgagcttcctcgatatgatctttaactctactcattaacttcaccctcctcgcagaacatttcaaaataacaatcgacacaagttagcatgccgtcgtcgcttacaacctcctcgggagggaagttgttcccgcaacattcgcacacaactcgatcaacctccctgcatccccagtaagccatatttactcctccttcagaagatactcattgctaataactttgaagctgaagtctcggctcatgcttttgaaaaccaagccttcccggtacttaccgttcaacgcagactcgccactagccattttaattacgagttgcatgtcttttggaacgcctacgtcccacatgtacaccggcacatgtttgaccgtctcaccacccaactggttcagcgtattcagaatggcaagacgctccgctggaagacagtaacgactgtccgaaatgttgtagatatcgtacacatagtattccggtttgtcaactccctcgaagttgccttgaatatttggtgcaaccagttcgccttgaagggcaatattcagaccgaaataccggagacgttcaccaagattaagctcttctgccatcgcagtgaagtgattggagtctttcttaatcacacgcttccagccccgacccttgaagaagttcttgatagcagtgaagaacccgatcttctcgtcttctagacggaaaccgacatttcgagacgccacgcctacttctccgtccttgtgccagatagtgagagacgaaccgtccaatttgaatgtcacttcaaacttctcgcccttctgatgagcctgatcgtaagccatctgaatattttgtacgcgagcctgatccgtcttcgggatgaagttggggaaccctagcttggaagtgccagtccggctgcccttgttgcctccattgatagctgcctgctcggaaggctttacatacttcaggatgcccattcgatcggtaacatcttcgtctactttcggctctgggctgcccgctgcatgaacaggtacgatcaggccttgactaagctctttacgaagcttcatggtcttgattcgagaatactcttttccaccttgttcgaccatattacggcctcgcaggaattcaaagatagggttatctacaggcaccatggaatccacttcaatgtagattgccagatcaccagcctgatattcccctcgtttgattacgcactgccaaccaccaacaagcgccagatcgaggctgtcagcgttaggatgggtcttcacatcgtcgatacgcaccactcgggctagtacgcggtcttgggaattactcatatattatcctccttgtttgaaaattggtatattacttgttaaaccagccgagatcaatagcccgctctagggccagtagcagattctcagcatctagaaggtcacggatcgcgatccaactaccactgtctcccggtagaccgtctgtgatatacacaggtatgtcactgtattcgctctttttaagcccgcaggcacaggctacattgtccccgaagacaatctcgctgacttcccttgcctcgtctcgaatatcgatcttcacacctaccctcctgttgtgttgaaagttgttgtattctgcccggatatcttcgcagtgtcaatagccttgacaagaaaataatccgtgatagagtgaggtctctgctggagagaaatgtccacgtcactcaccggccagcagtatagcgtatgaagaggaaagctgcaagcgcaacctgagtcgaatctgagaacagggcagcgacgacccgaaaggggaaagctcagagcctataaggaacccatgttccccgctcaccgactcatctgcatatatgtatatctgcatgagagcgagaggtagaccaaaggcatgtcttaggcggagattccgtatggcaagccttgggacaggtctgcctccactaccgatctatctgcataaagggggtacaatgtattcagcaactgttgtgaacagacactacgagaaatttgatgtgtatataggaagggggagcaagtggggtaaccccttctcccacaaggaaggcaccagagccctctacaaagtagatacagtggaacaagcaattgagtgcttccgaagtcatctttggcgtaacataatggaaggattaatcacagttgatgaccttctggagcttgacgggaagagattggggtgttattgtaagccccgtccttgccacggcgatgttctggtgagggcaatcgaatgggccaaacaacacagaggagtgtataaatgaaacatgttatttaccgagaagacctaatcgacctgttacgcgaccgtatgaagctccaagcgctggaggctggtggcgttgacaactgggactggtatgaggcctcgcttatcgactgcggattcttcgatgatgacgggcgtgagcttgaggtcgaagcacttgcagattgcttcccaaccgtaggtgcgtaaccgtggaggagtcgaaagctaccttcaaagacccttaccctaggttcttcgacgcttctcgtaggtatggcgaaaccaacgactgcatggtggtgagctttgcagtcgtatggaacaccacctatgaaaaggcacaccagcacctgaaagtgaagtgcaagcgcggttaccggcaaggggctactcagaagcgcttcagctacgcagacacttggtgccctaagacccggatgctctaccgggaggatgctaaggataagactcttaggcagtttgctgaggaaaaccctgaaggtcggttctggatcgcggtaaagggtcacgctattgcaatcatcgacggagtgttgtacgatcacactaatgacaaaagacgcaccatctggcactgctggcaagtgtggcccggggaggcacctgagaaaatcgagaggaagcctgatccaatctcacctcctgtgagaaaggccccagattggtatgtctgaagattacaactgaggaggaattatggaaattatttcgagagggacgctccctcaagaggttttgtttacggctaagtgccaccactgcttgagcattctccgggctaagaggtcggaacttaagtatgtttcgttctcattcggacgccccggggagactgggtattatttcgcagagtgccctgtgtgtaacgaagaggtgtctgcttgggttgtggttcctaccagccctgtagcacctcctcccactgtagagtatatcacaaaggagcgtaaataatatggaccagttagcaggattcatgggcgaacctttcgtaattgcgttcgactacgacgagacgatcagtctctaccctcttgccttccgaatcgtcatggataccttcaggggctttggaggcgctttcaatgtgatcgtagtcactgcacgccaccctgacaacagcggagagttagagtggctacgggactacgggttcccgatctatttcacggcacagaaggcaaagcgaccattcatggaaaatcttggaataaaagtctctgtatgggttgacgacaacccgttcagcgtggataatgaccttcctccgtggacagcggagcaatacgacgcctaccttgaggcaaagaagcaacgagctatcaacagagggagtaaagcatgagcgagattattaaggttgaagtgggagatcgggtggtccttaaggcctattgcgatacatacactggatgtgcaaagcgatgggcgcaggcgcatggtcgtttgcatgaactgctagctacggggtttgtagaagacagttgggtccacaccgacgaactggccggaggcttgaaaggcaccgttgtgatgactgaactgggactgaaggaagagtgctgtgcagtacgtctagacgcctacactgaccacagggctgttgtagttgttgacgcttctgatctttacatcgcatgtaaggcagcaaaagctcccgtaagcaccctagacgaggccttcggttgcgaccacgactaccttatggaatctccggctaacgctcagcgactgaatgagtccgtcgagcagctacgaactggccaagtcgtagaagtggacgtgcctatgagtgtaaagcaagacgaaactccacctgtcgtagtgcatgtagtagagaagatttacgataggaaaggtaacgtacacctcattctacagtatgaggtagcaggggcgctaatcaggacggtggttgaacagggagaactcatttacttcttggatgaaatgcaaggtatgtacttgaccaagattcaattggaggtgaacaatggagttgtatgaccagtggcgtaagtatatgagcgtcgtaatcttagaagaagaagataatgagcgtcagtgcatgcggcttattgaggcagttggcgaactcgatccctatatccaagatttcctagattctttctctattaaaactgaaggaggtgtgtaagcatgagtcagagtaagcgcgatgagattgtagttgaagcacgtgggctagagagctacttcatttcccactggaacggctgggatgtgatggacactgcttgtctcggattttatatcaaacctgagtatgttcttgacccggatattcgagagcttgagcctagcttcttggagcttgatttcgagcgttgccgtttccgattctggggaaatgaagacgaaggcgtggacggcaaactcatggagggcaagttgcagattatgaccaactccttcgagtacgtcttcttcaaggaggtttgagtggctagacagacttacgagtctgcatcagatagggcggtcgaggaggccgtccgttctgagcttgaagggcggtggaagtgttctcttcataagctacctagagcccactatatggattgggcagcctgccggaatggaaaggttgttagctttgtggagcttaaggctcggaataatgaaatgcagaaatatcccgacttctttgtgtcccagatgaagtggctccatgggatcgaaatgcaaagggtgtttgacattcccgcattccttgtggtaaagtggacggactatacaggatatgtcaaaatgacagccaacggcgtcaactacatgagcatgggtggcaggattgaccgtggagactggcaagaccaagaagttatggtccatatcccgctgaaagacttcacacgtttataggaggacacatgaagagactctgctaccgttgcatgcatcttggagagcctgtcatgctccgtcataagacgggtatctggtacaagggttgtagtaaatgtggatcaggagtattctatggctaagaagaaccctgtattcaagtttctgaatacagtaaacaagccctcagtggagagggataaaaccaaatacaggcggaagcctaagcataaacagaaggagcgattaaatgaagaagggtgataaagtgaggatcaatgatgatgctgataccatcttccggggccgtgttgccactatcatcgcagtagacgaagagggttgcgttatcgacgttgggagttacgaggatgagagcggagagctgatcgagtaccttcacctattctttgagcgttctgagttgtccaagcaggcgtaggagtgtataatgaacggacccgagtgtagatggtgcggagagaaaactgaagctgagttcgtagacgttgggcttggatggacgcagcaagtcactggaggcatgtgtcaccagtgtggagggtacgagaacggttactaccagaacgacggaaggctcacagaggtcgagtttgccacctactggagtggtccgttcgaagattatgcggatttctcgccattcaatcatatgagagaaggcgactcgccatgaaggctacactgagaaaccacaatctgctatacatctacttccacacgttctcggaaatgaatgagtggttgacagagaacgctgtagatcagtggacagtcactactctgggctccggctatcaggtggctgttcctatggaccgtgcaatgcgggaccaatacgtctcggaggggggttgacacgaacacaaggtgatgctaaactccgtggttgtctgaagtaaggaggttttatgtccaaaatgaccgtggcccaaattgcggctatgcacggtatcgatctgtattctgaccacaagaccgcttgtccccaatgccggaagaaaggcgctgacaacagcggagacaacctaaaggtctatggtactgatcgtaataccggggaacacaaaggtgcctattgttgggcgtgtgggtacaccttgctctctgaagagcaggaaagagacgcccggggagaagacgaagaggagtggaatttcgtgggaactgaatttaacgcagagatcaacgctcaaattaaagagcaatgctcgtatgatccgcgtggttatcgtggcctgtccaaggaaacttgccagtatttcggagtgctacatggtttcgacccggagactggcgagattgcaactcagctatatcctactactactaattatgaactcactggctacaaacagcggatcatgccgaagaacttctcagagcctatcggcgagaccgggaaggattgcgagctttttggtcagttcaggttcaagaatagcaacagcaagaaggtgcttattgtaggcggtgaggttgaccagctatcagcattccagatgctcaaggagtatgatgaccggcgagcaggcggtaagagtgattatgaaccgactccagtggtcagccctactatcggtgagagtggggcgtggaaacagctacaggctcagtacgagtggctagaccgattcgaacaaatcatcctctgtttcgacagtgatgatgcaggacgagaggcagcagacaaggcagccgataagcttccgaagggcaaggtgttcatgatggaaatgaaccgtaaagaccctaacgagtatttgaaagctggccgtcagtcggagtttgtcagtgcattctatcgagcccgtacatggacccctagcggtattgtagggtctgatgcactcgacgctcgaatgtatgaagctgtgcaggttgagaagattcctctgccaccgttcgctaagaagctccagaaggctatggcaggaggcatcccgttgggccggattgtgaatatcggcgctgcatcgggcatgggtaaatctactgtagtggatgagttcactctgttttggatttataactcgcctcatatgccgggtactgtgactctggaatcggactgcggggagtacgcaatcaagctgctgagccgtaaggtaggcgagaaggcagacttgtacgagaccgttgaagagaaagtggcgttccttgatcggcaccgtgacgctcggtacgacttgtggcacaaggaagacggaagcccacgcttctatctgatcgatgaccgagacggaagcctagcagccctcaaggctcaaatcgaacaactgattattcagtttgagtgccgtgttattattctggacccgcttcaggatattctggacggattgagcaacgaagagcagtcggtattcatgcgctggcaaaagggtatgaccaagagccaccgagtgacgttcatcaacatcaaccacgtccgtaagagtggtggtggtcagaaggctaactcggcaggtgctgaactgtacgaagaagatttccaagggtcttcgtccatcttcaaatctggtgcagctaacattctgatgtggcggaacaaggacgcggagaacgagttcgaaaagaacctgattaacgtgaagctctctaagtgccgatggactggccgcactggaatgatgggcaattggtactacgacgttgagactcatacaatctgggacttggacgactatctggaccgataccctgacaagcgccgtgaacacgaggcttggatggctcagaaggaagaggaaggccgggacacggaatactaaggttgacagaggggtgatgcttatgtatcatccctttcgtcgtttacaggaggaaaggaaatgcaacaacgatttgaaacaatcgagcaatacctcgaatggatgggaaataacaatttcaccaacatgacttgggatatcgaggccacaggcctgttggatgaaacgtctatcgattacactgccagcccctacaagattaagcctagctacaaacaccactgcattgtagtggaggagcacggtggcaatattctggcattctacgatgggccgacctacgtctttgacgggcgagagtacactgagagactgccgaaagcgtcttccatgctccacactgaagaagttgtgactctcaaggactacactccggtagagtatattcacctgccgctgaaagagttcaagaactatgtgctcaagcgcaagatcaagcgcgtagtggctcacaacatgattaacttcgaccttatgtcgatgaagcttgtggaagatatggacttcactatcggcgtagagcacagggatggcggtctgactacgtggtctgctgacacttggatgggcaagcaagtggtattcgacgataccctcgttatctccaagacttgtaaccctgacctgttcggcggtcacagtctggataagctgtctcgtcgtgcaggtggtgacaccaagattgacttccgtaagcatttggcaccggatgttcgattcctcgacttcgcagccgatatgctctactactgtatctatgacgtaaaggcgaacaccgctgtatggcattggttgcaggaccacgaagattaccaactgtccgaccgtgacaactacatcaagaattggctgtccccgattcagttggagaagaaggttgcagagatcatcacctatcaggagcaccgagggtttgttctgaatgttgatctctgtgaaaaagctgtgaaagacttggacgccaagatggaagagcgtcgggcccgggtagagcctgtgcttcctcctcgaccagctaccaagaaattcatggcagactacacaccgcctaagcggcagttcaagcagaacggggagatcaccagctacttgcagaagtttattgagcggattggggctcagttgaaagagggtgacgaccggacgatgatcttcgaaggcaaggagtacaagcttccgcttcccgctgacgtaccgctgaagacggaaatgcctgctaagatcggggacacaactcacatcaagcaatggcttatgggtgagtttggttggattccatcagagtggaaagagactgatctgactgtggatcagaagaagatcaagcttccgatggaaaacatcgttgctaagatcgatcgctggctggatgtaacgtatagcacagcgtacaaggaagagcggctggacgggttcggggattacatgaagatcacccctcgtagcacccgcgcgtatgtacgtcagaggttgattgatcgtgcaagcaaggggagctgtaaggttctcactaaccctagcttcacaaagggccaagagaaagaaatgtgtccagacctcgaacgcattgcagaacagtttccgttcgcgaaggatgtgattgagtacctgacctttaagcaccggcgaagcgcaatcctcggtggcggcatggactgggacgaaatggaggatggagaggagccggaaaaaggttaccttgcaagcattcgtcaggacggcaggattcccacgcctgctgacacttgcggggctgctactagccggatgaagcaccggaaggttgctaacgttcctcggatcacctcgttgtacggggctgagcttcgagagttgtttggggttggagatgggttcttccaaattggatacgacttcgattccttggaagcacgtaaagagtcggcctactgcgatcagtacgatccgacaaaggaatattgcaaatctcttatgatggagaagccatttgacgttcacacaatgatggctaagcgtatttctgagatcattggtcgtcaatttaaccgatctcctgcgaaaaacgtaaaatacgggtgtacgtacggtgcccaagctggtaaagtggcaaaaaccattggtgccgatttgcaaacgggtcaactggtattcgatgcgttctgggatgcagcattcccattgaaagctctgaaggacgacctcaccaagcaatgggaagccaatggcaagaagtatatcattggagtggacggtcgccgagtccctactcgttcggctcacgctatcctgaacagcttgttccagagtggcggtgttatctgtgctaagcgggctatggtgattcatgatgtactactggagaaagaaggtctgaaggttgactttttcaaagaagactggaagaacaagccggaattctgccaacaaatgatcgcgtaccacgacgaagcgcagttggaagttacagctaagtcggtcagcttcaagatgttcccttggtctcttgtaggcggtaagccagaaggagaaaaggaacaggaggaggcggagaagaagctgaaagctctagctcaggcttacaaggacgaacaattggctagtactggcaaggtgtggagtgatatcgcacactacagcaaaggtgaaggcggggtgtttgtagcttactgccgcgctggagaacttgccacgaaggccgtgagagctgcgggagagttctactctactcctctggtgcctatcgagctgaccgctggctacatcgttggtcgatcttggaaggattgccactaaaactggcattaagcgaggaaaggggcttgacaggcccctccgcctcctatacaatggccacatattcacaacatacaaggagaaacacaatgactctggctttcattatctatctggtaatgaccgtattcccagccttgtcgtcggctggtagctttgccctgatcgtcaccatcatcgcatgggttgcaggagggttcgtttacttggcatccattggtggccgagagaattcggcagttaaagccacactcaaaaatcacctacggcccttgacgttcaagctgtttctgcctatcattgtaatcggccatctggtgccttcgtctgagacggcatggtggatggtcggcgggtacgctgcacagagcctctatcaagcagacgctactcagcaggttctcagcgaatctactgaactgctcgaagctctggttaagcgggctaagaaagaaactctgaaggctgttgaaggcagcagcgagtgatacggtaatcacagaataggaggtatggtatgaacacggctcgactctacgtctacggcaaatcgtccatggtaggaatcactgttgacaacaaggccaatcgggagtactatacctctaaaggcttcgaggtatcggagacaccgttagcccacaaaagcgtggctaacaaatacaaacagaaaggaggtaaataatatgtctggtgttattcccgggactatcgtcaaactcactcaagtgggatgtgacgtcaccgttggctggccaaaggaagcccgatatgtaggcgcatacgcagtcgcagtagatggacgcgatatcggtctcccggaaggggaaatccggttctgctcccttcattggtccattgaccgagacgtcaatgatggacttggagactaccaatcgatgctcgctgacaacgaccgcttcgaaattgtagcagttccgggcaagaagtattacgttaagaacgttgccaagcacagcgcacagatcggccattacttggttccttcggagccagccttgtacgtaggtttcgagccgtgctggctgaagagcatgcacgaaggggagagcccgttctgcatgacttttaaaggacgcgttgacattggcggtgaaacctctgacaagccgcagttccagaccctctaccctgagctggtactggaagagtttaaagaagaggcggagggcaaggttgaagctccggttgacgaagagaagaaagaaaaggttgcaaagcctgctgtaatgggttatgctgttctcgatgcagacgggagtcctcttaaattctgcctcactcgcgaagaagcccgagccaccaagcgctggtggggtggcaaggctgagggagtctcgattgtaaaagtaatcaaaggagaggaggtgcgttaacgcgcttctcctcttgcagaatccgggaatgtccggtatgatcgtcagtcaagtggctgacacactcgcccagtctagggtacttaaataggagaaatgaaatggcttttaaactgaacgtaaccaccaacactcaatccggcaacggcggcgtccgaaaggaagtcgattgggatgctctgaacaaccacgtagttgaagctgctggcactgccgctaaagcgcgttcgatcccgggttatatctccggtatcatcgatctcggcgagcaagagcagaacgatgcagaggttgtgttcactggcactgccgaagatgaaatccaaatcatcaaggaatatccgaacacttacttcaaggatggactggacaagcagactcgcaagcctgtacgtctgaagtgctggccgcagcgcgatatgcaacaaatcgcgatcactgtggacttccctcagatcgaggtagacaagagcctgtacctgaccggtaacagcaacaagtctccgcttcgtgtcctgtacaacggcgactttactctgccgggtcagaagactaagattgttggccgtccgtttaccatcaaggaagtgaagcacccgaatggcaaatgggcgttcgccaagaactccatgttgcacaaacttgctgtggctactggcgtcatcaacgaagacgaactcttcaccaaggaccgcgtaggcgagcttctgggcaaggtggctcagttccaagtgcgagtgtggatgaagccgggcaagaacgatatgaaattcctcactgaggatatcagtctggtcggtatggttcctgaaggtgttccggttcccgagctggacgagaagtacatctacggtgtcaacctgtatggcgagaacgacgaagaagcagtcaagcaactgcgtgctaacgtcatcaacaccatcaagcgagccaagaactacgaaggttcggatatcaaggcgatgatcgaagccgttgaagctgcacgcggtggtaaccgctccagtggcgacagcgaagagcaagctgaagataagccgcagacccaagctgcacctaaagtggagccggttcaaaccaacgtagatgatgacattccgttctaaagggcggtggtaagacaaggggcttcggccccttcctttcaaaatttcaaaggaggcaacacatgcaaatcaattttggtcccatcttccttctcgcagcaatcgtcctgtgcgttctgaaatctgccggagttctcgctatctcttggactgtggcactcatgcccatctggattcctcttgtaattgtattgtcgattctcgtactgtttcttgtaattgtaggtctgatttacgcattcggcgatcgtactaaactgaactttagctttaaaaagcacttccggaataagtgaggactaatgatgagtagtttggttattgttcgagtacctgagtacattctaaaaggccccacagtaaacaaccagttcagcggtgacctgtgggagcgaaatctcttcaaagatttgaagaacgctgcggagtgtatcattaaaggagagccggcttatgttgctcttcctaacaaggtaaaccctgacactctacaaacagagtgggacattcaggttgtacagttctaacccaaggggagcttcggctccctttttcattggagataaaaatgagtgaaaaggaagaggatatcgtcctcatcgacggcgaccttatcgcctttaagtgtgcaagtgtcaacgagacccgctccatcattgtcagaaacaaattgacaggagaagaggaaacttggaagaatcggacgacttggcgggagaataacaaagacgaagagggattcaacgaagacaacttcgaaattgaggaccatcaagaccccaagcacgtgtcctacggtatctctgttgttaagaccatgatcgaccgaatctgccgccaagctgggtgcaagcagttcaagattctcctatcaggccctgataacttccgtgacgccatcccactcccgaaagaatacgagattaccaagggtaaaaagaccttcactcgtggtggcaggtacaagggtaagcgtacagggcagattaagcctcttcagctaggtcagctaaggcagtatatgatcgaagcgtatgacaccatcatccatcccggagaagcggacgacttgatggccgaaatgatgtacaagaacggtgtaagctactccagaggggagactactcagcgcgtgatcggggctaccatcgataaagacgcagacggcactctaggatggctttgtaactacgaacgtgagcctgttcaagtcaagttcatttcaggcctaggatcgctctacagggactctaagggcaaggtgagaggcgagggacgtaagttcttctacttccagcttctattcggagaccctgttgactgctaccgacctgctgacctgtgcatcgggaaggacttcggagaagtggcagcgtttaacatcattaatccctgcacaacggacaaggagtgctggcaagcaatctacgacacctacaaatcgtggtaccctgagcctgtcacttacacagcatgggacgacacagagcacactaaagatgcaatcgatatcatgcaaatgtattgtgactgcgcccacatgcaacgttgggcgggggatcgggtagactgtagggctgttttggctaaactcggggtagacttaggaggtgcagaatgagtgtaaggcctcgcccttgggaagacttcccgggcatctggaagaccgaagccgcgttcttgagttgggtcagaggtggcattcgccgctatctctggtctaagaacccggtcaagcttgagtttgctaaatcccgaaggatcaagatagccaacaccaatgaaaagagcaagctcaggaaccccactgtatggggctatgtgtgcgagcagtgcgggaaggagactcctcaagctaacgttgagattgaccacaagacgggggagttctccctgaagcgagtagaggatatccaagcgttcgtggaaggtgtggtgtttgtccgcataggagatttggctgtcttgtgcaaaccgtgccatgagatcaagacctatgcagagcgttacggactcacccttgaagaggcgggtatcgtaaagcaagctattgcaatccagaagcagaaagggtatgataaggccttcttgcaggaggtgggaatcaaacccgcatccaacgcagagcttagaaaagaacagatcattgaataccttaagtctaagaaggagggtggatgaacgaggatcgggtttacattgtagtaagagacgaggcaccagagtacatggtgccgactctggttgcacatagcatcctaggggcagacatggcaatggttctcctcggacaggaccgggccgttccatcgacggaccttccgtcccgtccgtatatgcatgcagcggcaaaaaccgccattaagtgggtggagtggaaacagtggagcttccgtaagatcgttgtacgagtttctgacaaagagtacgataagatcaagcaaatccctttcgtatatgaggggtatgagagaaccatctgcaatggcgaaggctcctgcctagtagtacctcctctgagcaaagaggagaccccgaatgttcttaaatttgcaaaattatggaggcctctgtgagagagaagtttttgagaattatgcggaagctgcccatccgggtaagggcttcccttgttatggcttggattgctctgttcttctggctcccggttgcaactgcgctaatcgttggaattctagagttcttcgataatgcaaaagaagagttaagaaacggatactctgttttgatcgaagctgccaagggagcttaccagtgcattaaaacgggagaggagttggagtcatgaccaatttagctacgtatgttatacgccacaaaaagaccaaagagctttggaccactcctaaaggaaagcggcaatggaccacgaaaggaggggcagcccgagcttggagaaacgcatatgagagtactacactaggagcgtactatgctaaaagagatatggaacggtggcctgacctgaacattcctttgatagtaggggccgctcccgcacgtctggccggctgggaagcagcatcttttaaaaaccaatcagctttcgagattgttgatattgctgaatccctgaagcacgaaagccagttggtgctcgatctactgaaagatgttattgggttcgaagtgccagaccacatcggagacggatatgtccgactcaccattaaaacgtccacatacgacgatatcatcaaactactgaaggaggcaaaatgagcatgactgacccccgagcgtatttcatcaaacaggagctggaggaagcaacgaagcttctagaaagagccctcaaccttctagataacgtccattgctacgatacagatgtatacgaggacattgcagcattcctctacggtcaagagtgcgaggaggaataaggtgcagcgcgatattagtaaaactatagcagaacttcgggacttgatcgaagctgtctctatgctcgacgaggccttggttatgatgcagaaaaacggactatatgatacggacttgtacaaacgtattgatgcgtttttgtattatcaaccgggcgagggcgagtgggaggaagtagaatgagcagcaagaaacactttgtaatctctgatacacaatgcaagccgggtatcagtctggactacatggaagctatcggtaagtatatcgtagccaaacgtccagatgttgtgattcacatcggggatcactttgacctcgccagcttgtcgtcttatgataagggtaaacgctcctctgagggccggagatacgccgaagacgttcaagtcggacgtgagggtctggacaggctgttcaagcctctgtgggagctacaggagcgtcaacgggctaatcggaaaaaggtgtaccaacctcggttgattttcacactgggtaaccacgaagagcgagcagaccgagcggccaacgacaaccccgaattgtacggcacggtcggaagtgaggaactgggtattcaggattatggttttgaggttgttccgttcctgaagcctatcgaggtggatggcatctattacgtccactacctacaaaaccacttcactgggaagcctctgggtggcacagcgaacaacatgcttaaggctgccggtcattcgtttgtcatgggccaccgtcagcttctggactgggcgatccatcctacaattgacggaaaacaaaggctaggcattgtgactggagcgtgctatcctcacgacgaggcttacaaaggctatcagggtaacaatcacttccggggttgtgttatgattcacgaagtgaaggatggttttggtctgccaatgccggtaagcctagacttcatgatggagaaaggaggtttcaaatgacggtttataagttctggtgtgaatgggatatcggtatcaatgagtgcctgtggcgagactactaccagatggaagaagatgtagctaaagccttgtcagattgcgggattgatgatactattgaggaactggaggacgcaggcctgctcggcttcgactctgttaaagttatcggctaattaggtaataggagggcatatggctgagtttttccttggggcggcccttgcaggcttgttctttatgtttagtatcactgcgagctttaccgccgaagatattgagaaagtgacttcaacatgcgagaataacgaaggcgtcaagtatttcggagttgacttcttcggagacggtgctgtacactgcaacagcggcgctattttcaaaatcgaccgcaaatctaaataatcgaaaaggagatataaaatgactgatttcaacatcacccctgagcaaatggaagaagcaatggcaggtatgaaccctgagcagcgggctctggtagagaaagccttgaccgaccgtaaatctctggaagattccatcgtgaccgaggacggtgaactggactatggcatgcttgcacgacacatccgcaccagcttgggtgatctgcctctggtaatgggtggccctgacttcctgaagctgatgatcttggttgctgcgatgccggagaccaaagacgatctcctgactctgcacatgaacctgtccttcattctggactgcattcgtgaatcgattagcgacgaggagtaacaagtggccgaagagattgtaaaagaagacctatctgtcgacgatctcatggttgactcagcagggctagatgccctgctggccttcctagagagtcagtttaaaggtccgaagggtgtactgaagggatatgtcactatgagagtgatgtgcgctaagatcgagagtcttgacgggtttcaagagttgaaagatatggaggtgaactttgagtaacgatatcatcaacgttcatgctgggcaaccgatttctctggtgcaacggtcaaagaatcctatcaatattcaatattgggacgccgataccatcccttacggaacagtcttggttgttaccgagaaaaggggtgatatacgaaagggagaattggtcgtaaggctggctagtagtgcagatgatgagcactctgttaaggtatgtagattctctgatttcttcctcctaatggagaggggttatgacgcagccagtctcggcgacgttaaacaagcgtatgatgttctgttcgaagatcacccagtgactacctttgttaactgggatcgggctcagcctttgacaaacagtgagcgctactacggagactttctgattggcggcgaccctaaagggatgccactattcaacatggctgttcttaaaaatgttctgtcgccttacactgccgacgatgaggaactttcagctatgtctgggaatcccgagacagtagagcacaaagaagttgacgaactaagtgagagggacgaggctttagccgaggtcgacagactcaatgaagagcttgttgcactgggtaagaaggttgtgttcgccaacctagaagattacctaggcaaagaaaactatgccacattggaagctatggctaaccacaaggaggctgtaggtagcggaggctcctctagttactacactgtcaaggtgaacaaccccactacgaaggctaacatgccgtattttgcagagtgcaacgatatcatcgaagcgctggatatgcgattcggtcaaggcaacatgttcaaagcgttgtggcgggctgcggcagcacagaacctaggcaagctgaaggccggtaacgatgttatccgggactacgagaaagtcatcttcttcgctcagttggagatcgataagattctcagagaaaggggttgacattctccccgaggcttgcgataataggctccaagttgaaacgaaggaggtgtgtagatatgatccagaaactaaaacagaagctcatgatggtgcatcctatcctcgctagcgagatcgtctggtgcctcaccttcgcaatgcttcagtaaaacaagggagcttcggctccctttattgtatcaaagatttaataaggagagtttatgcaaatttctgcaaaagtgattcaacacagttcccggatcggcctaggtacgaagaatcacagattcatcactacattcgaactggagtatcctcggtttattcacagtgaacttatgactcaccgactttttagtcgaaatgctgcaagtagtcgtgccattcccgttgcccatatgatccgacaggtggaagagaatcctgcgatgcctgttcactggggaatgaatcaaccgggtatgcaagctgagttcgaactgagtgagtgtttgcaacgtagctctcagtacctgtggaagaaggctgcaaagagtgcggctcggatcgctagcgcactaaataaaatgggactccacaagcaggtggttaaccgtctccttgagccgttccagatgatgaagaccgttgttacagccacggaactagataacttcttctacctgcgttgccataaagacgcacaaccggagatcaaggttctcgctgagaaaatgtatgaggctcttattaaagcgggcccggcagaggctctatatgacggagagtggcatgttccttatgtgactcggttccgcataggggatggtaagctgcgttacgcagattgtaacgggcaagaactgagcgtagaggatgctattaaggtatctgctagctgctgtgctcaggttagctataggaagaacgacgagactctggagaaagctcttgtaatctacaaccgattggtagatactaagcccgttcacgctagcccgttcgaacaccaagcaacaccgatgctccgcatctcggacaatcaaactggatgggaggacggtgtgacgcacttggaccaatatggtgacctctggtctggtaacttccgaggtttcatccaacatcgtcaactaattaaagggcacgtatgtaatgagtactacggccaagaagaggaaggagtttaaaaatggcagaatataacctgagtctggaagacctcatgctggtcgatggcttcaaagaggcgttccagagtaacaatgagaaggtagtaagggagcatctgtggactaacggcatggatgttaaaaactactcgtatgaaatggttttctgtcagcatcgcaccctgattggccgagtcgtagagggtctacgattctctggctttgagcgtacagacaaggagtggctgagcctcggttgcgcctctctggaagctcatattgcagcgtgtgatgatagtaatctacggttcactcttcgtaagatgcgaccagagggatcgacagaggcaacgttccacaattaatgcagtaggagtagatatggaagttacaaaggctctcgtagatgaggccgatattttcaataagatcacacaaatcaggactccaacggagtcctatgcccggaaatatccggtcattgtcgaactagcaaaccagcaactagaagagaagttgtggttctctagcgaaatgaaggtagagctggataagttgaacctgaagtttaagttggaacctcatcagcttcacgctgtaaagactgtccttcaactgttcctcaaatacgaactgatcgtaggcgaggagttttggatgggtaaagtagtccgaacgttccctcgcccagaggttaaactagcggcttcgatcctgtgcatgatggaattggcagtccacgctgaattctacaaccagatcaacgtagtgctggggatggatacagatgccgactacgtggcgtacaaggatgacccggagcttatgggacgtatggagtggcttgagtctgtgctaggcgacgaagacgatgttctttcggtaattatcttcagcctaacagagaccgcccttctgttcagttccttcgctatcttgaagagtttccagtgcaacgggtacaacgatatccctgtgatcgcacgcggggctaaccagagtgctgtggatgaagacttgcacggtgtagtttcggctgagatcatcaaccaatactacgcagagattggtcgaccattgtctgaagatactcggcgtgtcgagaagattcgacaagctatcgaccatgtatatgctcatgaatgtcgtattgtcgatatggcgatcccgggcggagaacttaacggcgagtcggctgaaaactataaagcgtttgttcgttatcgtttgaacgtatggtgccgtcgtctgggtctggaagatcatttcgagaacgatgacactccgatcaaagattggttcgaaatgaacacgtacgcttacaaaatgattgacttctttactccgggaatgggcatggagtacgaactggggtgggatgaagaggaactagcaaaggcttgggaagaggagctgaaatatgagtaagagagacacattcaactattccgaagctaggaaaaacagtcaagcagcaggagagactcctctgtggtatacgacggctggctaccagttgttcatgaagaaatattcaaatgagggagagtctgttcgctctcgttttgagactgtagccagagctatggctcagcacgcccctacggtgtatcctgagtggtgggaggaggacgaatacactagaggcaaggactgggaacaggtattcttcgacgttatgtgggacggttttgtaagcccatccactccgcttctgtcgaacggtgggctccgcaagaagggcactacggtatcctgtgcaggcgggttgatggacaacaacctctatgaccgttacaatgtaatgacggagattgcagtgctaacgaagcatagtcacggcacaagcttcagcctgaccaactggccatccgaaggcgatgccattcgtggcggagagtcacagggtgttatgcctgtcattcgtgacgttatcaacgtcatggaagaggtcgcacagggttctcgtcgtggtagctgtgcctacagcattaacccccgccacggggacttctggaacgttatcgatcacctgtacaagcgtacagaatcgaacaacgtcggatggttgctggacgacaattggtgcaaggctatggccgagaaagaccctgaaacgctgaaacgatggaagcggatgatgttcgttaagctggcaagaggcaagggctacttcacgttcattgacaagatgaaccggcacctcgcagagccgttcaagcgagcaggtctgaaggtagaggcatctaatctttgccaagaaactgtgcttccagctaatgacttctacacattcagttgcgtgatcctaaactataacctcgaactctaccgttcttggcctgagcatctagtgttcatcgggcaggttatgtcggattgcaacatcagcgagtacctcgcaaccatggacgaagttagcattcaggaccgaagggctctggagaagatttaccggttcaccaaggacttccgagcacttggtagtggggttctaggattccatactctgctccagcgggaacgattcccggtcggcagtatggacgctatgttcctgaacaacgccatcttcaaagggatgaaggagcaagcggaagcttgtaacagttggctagctgaggttctaggggagccagagggctgccgtggactagggaagcgtaatgccactacaatgatgatgccgccaactaaatcgacggcagaactcatggctggggcttctgagggcatcggactggacgttgctatgtgcttcaccaagcagagcgctggaggtgaattcttccgtgtcaacaaggtgttgctggagattatccaagagcgaggccttgattgggaagagtgtgcaaggcagatcaacgaacgcaagggaagtgttcagcacgtagactggctaaccgatcatgaaaaggctgtattccgtactgcctttgaggtgagaatggaagactacctacgactgtgttcccagcggcagaagtacatcgaccaagggcagagcatcaacctttatttcacgtcgaatgactcgccggcttacatttcgtacatccatcgtctcgccatggaagacccgaacatcctatctctgtactacatctacagtatgagaggagcgggagatatctccagaacagaagaatgtgaaatgtgcatgtaaaatcattggcccggggcttgacagcttccgggcctttgtgtattctgagcacatcaaaacaaggagggactaaaatgaacaaattctctgaagtgtactacacttggagcgcagcgtgctctcgtacaaatatcttgatagatatgggatggactgctacaatccgtcgagacttcactggcgggatcaaccctgtatgggttgtggagttcacgcgatgaacagcaaactccgcaaagagttcgataaatggtggggacaggacgagcaagaagaacttcgtaaatcctgtgccaaaggatgggcggaatatatctggatggctagtcgaagaaaagtgagtgttgagcttcccgcgccagaaggcggatttatcgacatccaaaagtacacaatcaatcgctgcaaagaagctatccgcgaaacaggactggaggtgttttaatgaaagaatattttaaaaagcgactaatgcagaccagtgaaccgttcgattcagcgacgcaagctatggacgtagcgattgcgtggggaggggctaagtactgcgaattcacttgcgtaactgcggataatcgcgtcatcagcatctgggagtacaatgacgtagagcctgataaaccggtattcaatggacagcaacgaatcttagttccaacttttgaggaggtagtataatggaacaaactattgataaatctcggtatattgtgcttgataacgaaggtcggcacgttctgaccttgtgcgagaaggccgcctataacctgcttaaaggcgttcagtggacaaaggacaagcatggtcaaatccatgtaaatggtgtcacaggcgttgaactcggagttcgtcaagggattatcgctgaagtattcctgtatccgggctacatcatcctagaagaggtagactaatggatatgttcgataaatacatgcaagttatgtatgaccgggacgctttctcaaggcgagtcggtgagttagaaaaagaggtagccgaactcaaggctaaggtggctatcgctaagtgtgatatgcgtgtcgtgaaaaccctactggaagatatccaatgggtgtatcaagacgaagctatctatactctaccgggctacgtttgcccttgttgcggggaatctgcaaactatgggcatttccaaggcagcttcgataagagcccctgcctactagcttgtgtactgagccggagtgaagcatatgaagcctaatgttgtagactcgctaggcattaacatgtgctacgcctgcggaggtaaactgtacgtccgaggagtatgcactatctactgccctgactgcgagaaggcagagaaagataaaccgttcgtcaggatgcagcttctacaggatatcgcagacagtaagaggcttgacacagaataatattctttgtaagataagcccatcacagacaaggaggagccgagaatggccactacagagaaaattattgagtacgtcgaggtgtgcatatatcgcttgcaggaggacgtgatggcctattctaagggcttcagggacagagccttgtctaatcggacaggctacattcacggcctgattaccatggctgaaatgaatgagcaagtgagtatcgaagactgcgacaagctccgagctaatctgcgggacgcttctgaagcagtgatgaacacattggacttttaaagtcaactaggaggaagttatgataaaagattttgtaaaactcgttggcttgtctgccgtagcctgccttctgcttgtatgtattataggcatgtttgttacagttctgcacagtggggcagagattgttcaatctcagatggaacagaaagacattatcgtgtctaccgatgacggcaccatcaatctcggtcgctccgtgaagagcgagaagctgctgtacagcatgtgcatcaaggtggaagaccgtaagccagcttgcgaattcaccaccaaggataaggtagtacatgaagtgcggcaggtgatgcgcccgggcgaggctactgcacgtgacattaagattgcagttaacgcagcagtgacgtatactggagagaatggtcagaaggctacctccctgatccctccgaaaggtgaattcctgccggcaggtactccgtcagaggtgcatatcgaaacgattgaccgcttgttcgacagcgtgtataatgactacaagcaaaacttcagcaagatgtgaggaggactcatgaaagcacagcctaaagaagtagagaccctatctttcgacaagcgacccaaggccggggatatcgttcgactgcggtccgatggcaaggcttacgaagtgtgtgctgtgtatccgacagcggtaggctgggaggcggcgcttcgaagcgtgtacgacaaaaccaagactgtcactgtcggcatggagtggtgaaatgtccgcgactaacaagtgcgtcaacttcctccctgtcactccggacgggcgagtgatcgtccggttcggtaaaaagaggttaggatggctcggtaaagagggtaaaaagtggtattattacccttatggatgcgaaggcaggatcaaatccgaaggcttcaaaactctgatcgatattaaggcgtggattaaaaaccccgactcggtttggcccgggcccctagcttgagattgactaataagccgacgaatggtacaatgggatgtaggaaattccctactcagtataaggaaactagcaatgactagccgctggaaagaggccgtgtatcgcaagtactcggtacgtcgtctgcggcaggaactcgaagagttcaaagaagctagacgctttgcaccaaatcaacgcatccgtgcatggtttgatgctcatatcgaatttctagaacgccacttggctattcgagagtccggccaagcctacccagacgaccttctgtaattaagtgttgtaggtagagattcaaatcatggttagtggcaaggacgccacactttcagcccgcccacaaggcgggcttctttttgcctgcaattcagggttgacttggagtaccagagcatgtagacttaccccgtccaacacaaggaggaataaatatgaaattcaatatctcaagacagttatgggtggctaaaagccaacggaagggcgattacaagggaacgcccttggcgtacatggctcaagtagacttcaacaaggacggaagcttggcttctagcttcaagaagaagcagcagacaggtgagggctgggcaggaaagagcgctgagacgtgcttcgtagataatgtcccggtaacggggcacttcatcggcgacagcgtggagcgctgggtgaccgagaacaagtacttccgtgtaacggacccgcgaggtttcgttctggaagtcccgaccgggaacatctctaccctgctattcaactgcactgtagtcaagggagtcattcaagagccttgtgtgtgggttcggatgggttctcagcacgttctactgccggaaggttcctctctctacaaagaggctgtaagcttcgtggagcggaaagagtcagccaagaccgttaaagatatggttgcaggggatcgatgcaccctccttagtaacggtacagaggcgaaggcggaggccatctacctcggacgggtgaaactcacttggcaccttctggctcaaaagggccggtactctaaccgtggacgtggcgggtgggcttatcgctggggttaccaccatctggagcgggagttagatagaaaagaattcaccgagaaagattccaagtgggttagtgtgtttgctaagaaactgagtctcggtggacgatggaccctcgacttcgttctatcgccgaaggccactgatattcagtctgggacagttccagaggaacttgagaatctggacttggtagatggtgtaatgtgggagtatgacggagaggatacccgcccaatggcctactactattctgtacctgatagggtagtcaagtgtatcaacgtagacgaccccgcatgggacgctcgatcctacgatgaggtaaggtggactaaagagtggactgtagtgggtgccgagtggcgaaaataagccaccattattttagaattgcccggcgagagccgggctttttcatggcaggggttattttcaaattatttttagatttctgggagtttcggccaatatgggcaatatgaaatttctcaggaaaaggctcagaatgctcgtataagagccgttcgagtgtaggtatggtgagctactacttagccgtagaaggacagtgtaacgcttaataggagggttagaatgaagattgacaacggtggcgaatatgcgtattggctggcggatatcaaagagtttgtttctcagatggatgccacagagatcgagaagagggcttgtatagcatacttaattagctggtatcagcgaagagtactgcacagaattaaacgggaggaatacgaggagatctaagctagggaccggatggatttttagggactggatagattttcacagactgcaaaattgagaactgggcagatttttaggaactggacagtttttcacagaaggggatttttctacagaggaatttcccctgaaatttagccggatttctcagaagggcggatcgttagcaggctatctaattggttagcaagctacctttaatcgttagcacactaactaaaaattcctaggacggacctcagttggcacgaacgttgcaagcccgcaccagtttcccgggcaggcgtaggcctcgactatccgtcgtgaaggcgatatgtagttggggactcgcaccccgcgtttaagatgtgcccattctactatgacagacagctttgtcaacattctttttatggcataggctttgcaattgcaattaacatgccaacacaaatatcaggctcctccggtgtttatctccggtgctcggcttccagcctgcgttgcccgcatgcctactattatacacaagctatcaagagaagcaagaaaaattatagagaaaaatctacacaaaggaggttgacaggcctcctttatatatgcacaatgatctcacattcaacggaacgtcaggtaagcatcatgctacatagtgaagcccgggagatggccctacaagagatgggcaagtggagtctcctcgaacaaggttggaaattcagtttcaatctcaggatgaaacggacgctgggacgctgtaatcatactaagaagctcatagaacttagctacgggtatgtagctgctaatgggctcccggcaatattggatactatccggcatgaaatagcccacgctaaggcgggaccggatcagggccacggatttgtatggaaagagtggtgcggcttgattggcgctaaacctcagcagtacgccagcacaaaagaaaaagtagtcaatttcccgtggcaactggcgattcagcacgactccgggcacttagagcggctcaatcactacggtttcagacggaccaacatggcgaaaaagcaggtacgcgggcgtcctgagacaaagggcagactagtttgggtgaagagtgaaaataagggttgacagcttaggccattcgcgtagaatggccctcaagcaaagggaaacaccctgagcaatcacgaaggataagtagatatgaaagcgctttgtaatcatcgggcactctacgcagcttacagccgtagcgagattgatcgcgttgcggtagacctgaaccgttactttcctatcgagaaagatgatgaatgggaagatggaccgtacatgtaccgccgccggacctatctggtgaagcattcgaagggcatagcaaggtggcacagtctctattgcaatgggaccgtccaaggcgttggcgtaatcttcgacgtaaagtcgggcgaacctttccgcacagcataaggagattcagaaaatgcaagcttgggatgtgtatcagaacggccaattgatcgatactgttttcttcgatatcatgtgtgatgccgaagaggtgcggaaatcgctggtcaatcacgacggatactcgtctgatactactgtagaggaggttgagtaatggatagtctatctgttaaaatcgttctgtcggaactgagctacaaggctctgattcaagccttcgccttgcttggccgaacgctcgacctagacgaggggttggacgatatacttaatcttattgcggatgagatcgctttccgcgacggcctgccgcctttcgcagacgactgcgataaaacagaatggatgctccgtcgatgggaatcgctcccggtggtatcgtacaatatcgggcaggacggaccgattgtcgctcggtctatcgaagtaaaaacggcatgaggggagaactgatgaccgtcagagtaggagatatcgtggctatccggggcgacattcggaaaaagctcgacggaacatgccaatacacgcccgaacaattggtaggtggtaaattcctcaagcatgccggcacgggagaaatatggactggccgagtgagtaagatacaaggtgatatggccaaggtgggaggggcttggcgcgggatcgaattctatgtgctcattagtgaaataaacgcttgacaacctgacccactagctgcaaaatagcactcacagacaacgaagacgccgataggcgaggagaaagcagatgcaaatgtttttcaaaacccgcacccaagcccgtgcaatggccaccaacggtcgcaaagtggtagacaacggggctcaagctgaaaagcgctgggctgtcaagctgaacaaaaaggaggcgaaataatggctaagtctgtcagtgtagatcgcaagcgttccatcctcgacgaggcgaaagacggtagctttttcagtgtggaattcgtcaaggcagacggcaccgttcgaaagatgacgtgcaagcgccagattaaatcggcgtatgctaacggacagtatgccactcgcaaaccgaccagcgctggcaagccgcacctgtataccgctgctgaggtgctgaacatggaagagggtaaatccgctttccgtacgatcaatctcgaaacccttatccgtgcgaaggtgaacggaatcgagtataaattcgattaaaagcttgacagcctaggccattcctgtagaatggccctcaagcaagacaaacttaaacagaaaggagattaaaatggcacgttctatcaaggcttccgacttcgattccgcttaccagttcgaggccgccaaacgttccgaacgtaaagagtcccgcaaatcgcgtgacaatcgcaaagctagccgaggccgagctttcgacttcagtagcgatatgtaaggtttgtgccctgccggcaggcttaaatgccggcaatcctaagcccattcgtcgagtggttttaggattctcaaccccagcggagataccaaaaatggttcgtcaatgcgtaccctgtcccgatgctcgccatgctttttgccttgcatggttgttcgccatgccggagttcgccggtctgcccgctcaaaaggacataaaactctttaagacttcgggacaatgggcggtatgttatggctagacgacagcggctcccgtcgtgggttcaagaccagaccgaggatgaaacgccgctgagggacaggatagacccctaccttagcaagcttggcgaagtcgataagctagagggacaattgcgacgggtcagggatgcaacggacccggacgaatacaacgaaatggctaaggtactaaaagcccgacgccggaagataatgaagcaacgtgcccgggcctacggtctgccagaggatgagcctaccaatgtccaagggtacagcgtaccggaagaggttcaccgtagagccatcctgttaagcagtgtaaaaccttggatgttctggaccatcctgtctttctcgatttttgtgtggtttgttttgaaaaacagttgacaaggttcccgcctcctgtagaatggtcagcaagaaaggcggacaggccgcctagctagataaaggataaccgtcatgcacttcgttcttaacctcgtttccaaaaacagcaaaaccggtcccatgcctgttagcacgtctcataacggcacctgcccggatgcctgccctctcaaggctaaaggctgctatgccgcttatgggcctactgctattcactggaaaaagctaagcaagggtgaacgtggcgtagagtggaaagagttccttaagcaagtgcggtctatctcccgtggggatttgtggcgtcataatcaagctggcgatctcgtgggtcaggatgacgttatcgatgggatcgccctgatggaactggtgaaggctaacaaaggtcgtcgcggcttcacctacacacattacccgatgaacaatttcatgaaccgccagcacgtattgtcggccaatcgtagcgggtttactatcaacctgtcgggcaacaatgtagcgcacgccgatgaactggccgacctgaacatcgcccctgtagtgactattctcccgatggacgcggagaatgtaagctttacgccgaaaggacgtaaagtggtagcttgtccggctgagaaaagcgacaaggtgaattgtaagtcgtgcggcttgtgccaagtggccgaccgggagtatattatcggcttccgtgcccacggcacagcaaagaaaactgtcgatctcattgctaagggttaacacaatggacgaatctgtttacgcaccattcaatcagtgtaagatgatgggcctagaacgaaccgtgcggagcctagcggctcctaacgggtgcaaggtagtcttgtatcaggaccataagaacaagcatagaatcgtcatatacgatgccttagggcatggaatgtctggggtcatggtgcaagcggatggggaaattcactacaaggaaactcgcaaggctagccaagggcagaatctgacaaggcagctacaagctcagctaaccgcatggggagtgaagtggttcccctctcagtatcagacagcggcgggcgcggcctgctacaaaggaggcgagtgatgcggcagcttaacaaatcccagcttaaggccttggggcctaagatcgacctagccttagagctagcttctactggccgtggtggtctaatgaatggccacggctctacctgctacattgcaaacaaagccgggcataacattctgcgggttagctaccataactcccgattcgttgcatatggtgctgagagtgtccgggtgactgggaatgtcattgcagcatgggtggaatggaagggcattaaccgggctgcaatcaacgctctgagtgagtacgggtatcatcctaacctgagcatagggcacaacgatgctcttaagactctgcgtgatatcgagcgttaccagtgacggcctcttactcgacagagaaacggggccagaggtgggccatcatccgtactgagcccggttacagaggtgaccgggtgaccgtgctaggattctgtatcaatcaaacgcacgctcttaaaacggtagccaaattccgggcttggcaagcgctaggctggccctacacactgaaagatgacagaaaataaatgcttgacagcctaggccattccagtagaatggccctcaagcaaagggaatcaccctaagcaatcactaaaggcaggaacaatgaaaaccacagagcaacggcaagcaatactccccggggccgccggcagtcaagcgacgggcgcctactacccgatttactgggatgaccggggctacttcataggcccgatgcgtcactggaaaatttacaatcgctgcgtctgaagcatcaagccatgcttctaataaccaaccatctggagactcaaaatgaaagctgtagcccagttcaaaagtgaagactacgaaagcggtgatagccgtactgctaccgtctatgaggatgtttatggatgctacgtcgtgagcgttttcggaactagcttgagcgaacctgtcagctaccattggggtccgttcgagtataaagaatctgcaatcgatgccgctaagtctgctatctaactgaaaaggggccacagaatgaaaatctccgctattctgaaaaataacctgaagttttacaagaataattcgttcatgtgcgctctggcgttcgataatgtgtccagaaataaagctaccgaggtgcaagaatttatccatcagctactagggcccttcgttaccttgcacgctaagctcaagaaagagataccgggttacgaaagagccgtatatgatgatgagccagaggatgaaatgactttctttgtatcggatagggcctatcaaatgcgttgcttgtggtgggaaactgtaatcgaacaactagaggaacaagggcaatgactcaagctaactggagcaaaggcgtccgggttgtcggcggaaagcgggatggtgagattaccctgttcacaagcgcacacttcagtgaatcgctaggcttatgcgagggtgatccttatctggtagaggctttgccgatgcccgccgcgctccggctgctagtcaaatggaacaagctgtgcagccgaatgaagcttgactatcggtatgaactgctgtagtctgcaatctcaatcaaaacaggaatgctccaatgtcgattctagccttaaccctgaccctttgctctgccgttcaatgtgatgattacattatcgatcactcactcccgggacaagccgcagagtgtaatgctcggctggtggaggaggccgaggagtggggcgatgcttgggtatcaactaacgctgatgcccgactgacccgctaccttagccggttcaatattcaagttgaccctcgctttgttttcgactacgattttacctgccaactcatcgcagaggatgaactaccatgaacgcgccccatctttccctcaagcagtaccgtcaacgtgccgctgtcatcgtccgccgagtgaaatactatgaaaggcgctggctccggaccgtagagtttttctcaggtgctgccgctcagaacatcgcagaacgctttgcctacgctgggcatgctgaagagcaaatgaccaagctcaaggctgagtttgcagccttcccggtggaggtgaggctagatgctctaggttggatcaattggaatactcacaatgacggcctgctagaggagtggattcatcaggaaaccgaccgagccatcatgctcgaatatgacgaaaccacgtggcgtcctgtagcttgctgggaaaccactgtcgatgctcttcccaagctggcaatgctgtaaaatatcgcccgttaggctgaaataatgcttgacgggcgtttttgtacctgtagaataggcctcaagaaaggaaaacagccgaaaggctcaatctgaaacccggagatcgataaaatgctgctagttcatggaaccactgcaaaaggcctgaaagctatcatgaaccgtcgaggcaaggagggattggccgcaccttgggacgtttcggaccatgacggaatgtcctacttttacaacgtaggcaagatggagtggcacgacgaagaggagtatgctaaggcagaatgcatcgttcgttgcctagaacaggcccaattgcagcaggctatgatggccgaaggaggtaaaatctatgctctggtggttgacattcccgaagagtttcaggattgcgtagaggatgattattcgtgccctaacgctagccaccaagctagctgttttccagaggataattttgatccggcatggattgtagaagtgtatgaggcagatgtgagtgtatgggccatccctttcatcgtagccggagtctcaggtaattctatgttccaatcccaccaactacctgacaaactggtggcgatagcggagtcggtggcgcggtccagtgacatagacacatacgaagctttcgagatcgaccattcacaggtggagctatctattctcgaaaatttcaaagataacgcttgacagtctagccaactagcgtagaatgcctagccaaggggtgcataagcgccccacctcgaaaggatacagaaaatggccatcgttgatcgaaccgcaggtaatgaaagcccgaatcactgctacatcgttactggcagcattggaccagagtttgagccgaccctgttcactacccatgcgctggcaaagaagtatgcccagcagatagtgaaatacggtaaagcaaacgacgttttcccgccttttacgcctgttatcgagacccggcacaaggcagatatgaatcggttcactgttcacaacaaaatccccgaataggagacgtatctatgaaactttctgaaattttccaaaaaggcctgaactatgcaattgagtacggaatgccgtggtatatgtgcatccgtctccgggagattcatttgttcccctcgcccgttgaaatggcagttaactcggtcatgatgtctgccggtatctcatcaaccccagagggatgcgaattcgccggcgttgatgactatttcgaggaaagcggcctagcagccgcatacaaaatgaacaatcaggaaatgtccgaatacgggcgctcatcctacgcaatgtgggtgcaattttggttcttcgtaatctttgacttagcccgaaaagggcagtagaatgcattacaagcgtagaacagccagcaaataatgtgatctagagggacggtcatgggtgacaaaactgtagtttatcgggtggagtgcaggaacggcgagggaccgtatgttaactatggtatggagattgatacgtcctccactcccgagcggcccgtaccggagcatgacgggatacctgatgttcgccattttgagtatttcgccttcacgtctcctaaacaactagatgactggttcggggactactacagcaatctgaccgagcactccagcgcctcaatcaaaatgtatgaggtggacaggcagcatgtaaggactggtctccggcagtgtgtattccgcagagatgcggcggtttgcgtcaaggaaatgactattgaccaatgggtaggcctgcttaaggctggcatgatctctgcggtagtcgtacaagctctggccccgatcccagccgaacaactatccctagacctaggggacgatccggcctgtgaggctcagaaagaaattttgaaaatgttcagtttatagggttgacagcttgggccattcgcgtagaatggccctcaagcaagacaaaccacaaacccggagactcaccatgaacaagccaatgaatactttcgcatacgcccactacgtcgcccgcatggacaaggcctctggcactagcctgccctacgccaccctgttccgcatcgccctgcgtaacgcctaccgcaagccgggtgtccgccagtacgattgtgcagcactcgtcgaggatatcaaagcgcgtgaactggtccaaaagcgcattcgggctgaaaaagcagtagtgatggcggcagtaatgcgtgcaattcgtaccggcttcaccgttagcgtgaaagatggcagcgatggcgagtgggtagtgaaaaagtctaccgatatcaaggaaatctctgatagcctgcaatctaccgacgaggatatcatccgcttccgcaagggcgacggcccggacaacatcgtcggctctatgtgggcaatctacggtaacagcgccggcgaagtgatcgccgactggactgataatgccaccatggccatgattatggctccggctgagcggaagatggaaaaatacgctgaattaggtatctaatgcttgacggggcccgaaaagggccccataatgcacccataccagcaaacaacatcaggaccgccccgatgagccagatcaaaatccaagagtatatcgtagccgagatcaaggttaaccattgcgctcacctgcgcaagggccagaccatccaagcccgcgatgctcgtagcagtgaaaagtggattgcattcatggtggaacgcgggtatagtgcctctgaagccgctatcctgttcaaagatgcacatgatgtggcaatgctcgaactggcagcctgaaaaaatcctactaggagtactgacaaatgaaacgccaatatactgattcctaccagtgcaaagcaatcgacggcctgatgtctatctgcggtggtaagaaagctatcgtacaagtgtggccgtccttgaaagcctctcgaaaccgccggctgaaaaagatggtaaaatacattgcccggtcaggatggaaaccgtaaccaactgattatcacagccccggcttgccggggctcacaataggagataaaagcatgaataccctgattatccgtttggattccgcctacagcgttcaaactgtccgtagtttccttatggaagctgtagagagtattcgaaagcatatccgggactacgcggttcatgacgaatacgattcgggattgagcccggtagcacccaatcatcgacttgcaatcgtcaccttagacgaagattgccgagtgtttcacattcaatgcgagtcacctgatctttatctggcgaaccctcggatcgtgtttactgatgttgaaagcccggcatataccactcccgtgaacgagatcgaagagtatagttacatgaccgcatggcagcatatacgtcaaaaagatatgacagcaaaagactacctgtcggattggtctatccttttcgcctcaaaggagaatgccattgatatcgacctgcgccccaatctgaaaacgcaaatcttgcattaactgagggagctaggatgaagcttcgaaccatattcgaaacctacgattgccgagttaggtttgtcaccataaccggcgtgtttgtggaatctcaaattgtgcggagtttcggtcaagctcaggagattgtatcactcctctgcaatcccgcagatactggtatccgtctatccttcttcgacgaagaggagggctgcgagtcgatcctctgccgattcaactacaaaggagaaatcatcaaatgaataacaagtataaggataacatcattgcggaatactgccatttcgacggcagacggccagtcctttccttggcggcacgatgggtccaccacgacagtcgagttgtgaagctggcagcgctctttgcctgtgctggctatggccgtccttacaaagattgtattaaggcctacaaggacgccaagcagcgggaaaaggatatgcgaaaccctgccaaatggaagctgagccgagcgactaagcgggctctacgggctcgactagtggctatagaaaaactagaataatccggaaaatacctgttgacgtgaggctagagggttccctatactgtgcctatcgagacgcacaaggcgtctcctaagctagaaggactagcaaaatggcaaaggcaaatctgaagttctcccgcattggcaatgacggctacgactacgcccgcagggaagacggggtttggtttgtcagagaagggtactacgggcggtacggctgggctaaaaccaaatggactcaagttcaacccggggatggcatgactatagtcgatgcctgcctgaaggctcacgaagctggaagctccagcacatacatcggattcgggaatctggtggtattttccgacgggaaggggctccgtttaccctgaacaggaactcaaataaagttgttgacagcttaggccattcctgtagaatggccctcaagcaaagggaatcaccctgagcacctgaataggtaaaagacgatgcaagcaacctaccaagccctgaaaactctgcgcgatgcttgtgaagctgtcaaggatgaaaaaggcaccatcaacggaaacaaattgaatgcactgcgtaacaaggctgtcaaggaaatgcaagctggtggtgaaacctactctgacgccattagcatggctcacgacttgattaagaagtatcgcaagtaatcaatccgtaacaagccccgggtgaccggggcctctcataggagagaccatgaaaaacgttcaaatctgttgttcgaagtgtggagccatcaacggcggtaacagcaaacacaattgggttatcgcattaggcaagaagtggtgcggtcattgtgggtccaatctcacaacccttcgtcgctaaccattcactgagacctaatcgaggagagatcatgaacgccactctggcacgcctacagaacgaacgctgtgcaaccctccgcctgatgctgctgccggaacatcgtgggtatcagttctctggccatccttgggccgagcgcatccgcaatctccacgatgaagccaagtgcatccgcagccatcactaaaccgcactaatccattaaaactctaacagcccgccttgtgcgggctttgttctatctgcgaaagcgacagctttcaagtgtaattaacatgtaatgttgtaacactctgtagaggtaacaccagcatgacaagatagaccacttgtaacgttgacgttacatgtataacagcatgacagcgaaagctgtacagatagcattctgtccagttcacccctatcaaataaccccacaataacccacctaaaacctatcggttttaagcggcctgtaaggccgtatatgaagcgatagcttcgctatgttagtctgcaccatcaaggcgagagccttacagcatgaggcttgtaggaggttttaaggccatatgcgattagcataggatgttggttgttttaggtagatttttggtataacccctttcagcgctaccattgtcccggtgatgttaagcgacagcttacatccgctcccattttgcaatggaaattgcatacagttcatcatgcgcttcaaaagtgacttcactttgcatgcggatgcatgctatagtataccctgtgatagctccgctatcccgttttgcatggcacacgaattgcataagcatgacaagggtaaccctcgaaagcggagctttcaaagtgtaggctgagtgtgggctctacctctattatatttgcgaccggaagtagtgacactgaaaacgttgactctagcccagtaaatacgttaaactaaaaggttgatagctgccgctatcgagtaaccaacattcacacaaggaggcacaatgacaagcaacaatcatgccaagattcacatccattacgctaagcaaatctactacgccatgcgtaaacgtgccatcgcaagcgatgagatatgcaaggaatgggccaagcccaagacaggctttgaagcgttctatgattgggtggtgaatgtgtcagggtacgccgtaggctaccgcctagacaggaatatcctcttcccgggaaacaagctctatgctccgcatacatgtgagttcacacctacatacatgcatactctattcaccaactgcgacaagacaagcaataaccgtgccaacaatgatctacctctaggcgtccgcctagcccgtcatgacaagtacggaatgccagtatacgtctcacagtgcaggacactaggcaagcagtctacccttggatcgttcgacgatccgatgcaagcccatgcggcatggcaacatgccaaggtagcagccatcctcgaatgtattgatctctatcagatggaggatgttcacagtgtaaacgttgttcaagcgttgcttgaaagagtggacaaacttggcaaggatattgcacagggaaaagagacaacccttttgcaatgatttgatggggtcgatggtcaaccctctgagagtgcgagaactccgccagagtaatccgatagcgaagctatcaaacgtatatgcatattccatgccaacatgtggaaagatttcacccggcagggcgggagcccgttggcattagttttgcatagcttagctgtcgctaagaaggaaagaccacggccacccattattttggatttactaaggg

SEQ ID NO: 5 - DNA, 74485 bp, Podoviridae Luzseptimavirus
  misc_feature (1)..(74485)
cagtaggaccatcctcaaatccggtactcccccccggtggtgttcccctattgagttttccgcgcttgcttacctctgctggccttcggccttggggcggatgatcgtccgaaccacctaccttctactactctggagtattcctcatgatcgctgcattcaacgccttctttgccttcttcgctgctctgttccgtggcgctaccaaccttgccgaggctgctgagaacatgtctcgctatgccaaggatgaatctgagttcttcaacgagaacgctgaagcttcccgtgaccgtcgtcgtgtcgagtctcgtgctgctcatgctcaactggtacgtgacctgggtatctccgaagacatcgccgagatccaatccgaacgtcgtaccaagcgtgtaactggtaccaagtcctaaccctctagcctcactccttcacgggagtggggcttaactctttcaagcacacatagagcacacatcaagatcaagagcacacacctactcccttcttcctgatactcctctgcgtctccctcttctccctttggacagttggttgtaggaagtaacctttccctcttcttagtcctactaatcctgcttataggggaaatgatgagaggtttgagtgactgtgtactgcgtagagttgcatcatctccctcaaggttcccacacctacattcttccataccctcacattcaatacgatatacacctgatactccatcactattcccacccacttctgctacgcagttggtatggcttcatgcctgatcattacttcatagtcctctataggtatctaccatgcgtaacaagtacctcttccgtaacgtgaacctccgtcaagcagctgctcattggtggggttgtggtttcgaacctgatggaccagacgtgaaggatctcctcatccgttgtggcttcagtcctgctcaatccatggagacagtacgtgctgtcttcgactactgggatgctgactacaaggcgtactgtgacaaccacatggacgaagagtccttcgaacctatcaatgcctctggcttcggtgacattggcactcaatccatttccactcaggagtaacaccgtggagatcacatccatctgtcctgaagatctgattacccttgacctcatccactgtggtgaagcacagaccttcaagttcaacaccgttgaagaagccttcgctgtgatagtgggctttggatacgagactctgttcgacgtatccatcagcttctgggacttggactgcaaccggcaggtatggaatgcagaaaccatctcccatctgttggcccaagctaccgtcacccttgaaggtgaaggctatgccactcatgtgaaggtggtgctctgacatggataccaagatcttgaaggaagccatccatgcaggcatgcagatggccctgaagacgaataagctgaactccatgtgtatccatgtctctgcgcaggcatggagtggtggtgtactcaccgtcgttcacagcaatgagttccgtcggtggatatacaagatcctcggcaactactgctacgtcaatgactacctgcgttcgtgccatcctcactacatgcggtggggtggacggaacatgtggtgcaacttctatgtgtgggcctactacgatctctgcaaggagcaaaaccatgaaacccatagctgaactgatctacctgggtatgcaagaggcacatgccacgagcaacttccagaacatgtgcctccgattggagcggctggtattcgagaacaagatcatcaggcatgacctggatcgctttgaggattggatcaattcgcacatgaagggtggtggatccatcctctactacctgttgaagaatcacccgagtctacgtgatctacctcagcttctgcgtaccaacgaactgttccgtaactactggtgcaactactacctgtggcactactttgacctgaccagaaggagataaccatgaccactttcacccttgagaaccagctgttcgtcatcagactactgcccaccaaaggcaagctggagggttaccgcatctgccttaccctcatcaagggtaaagagcgtcaggtgctggtacatgagcagatgttcgggcgtcgtgaagatgctatgcacatccgttcgctaatcactgcacgtcgtgtactcaacctcaaccattgggtttgggaagccaagtccaacatgttcggcgatgcactggcccacaagcctactgctcgcttccgtaccaaacccatctacctctctttctgaaaccaaggagtaaggcaatgaccaagatctttctggtcggcttcggtgtctctctgatcctgatagtgcagggactttacgaagtgtggatctataaggaggccatccgcttgttcggcgataaacggctgttccgtaagctcaagtacgcctacaagcaggtgcattggggcttgctcagtgccatcttcctggcctcggcttacgttgtactgatcatgtgaggtaggtatggaactgctgcttctcttgaaggtggtggctatgttcatcctgatgccactggccatcatcatcttcatgtccctgatcacctgggtattcacccgctaattcaaaccaaggaaccaaaccatgaacctgactttcctccgcaagtgctctgcccacgctgccaagatccacgctgcactgatcaaggcatacaacctgtcctggatcgatgagtgcggtactgagcacgaagaagacttctactgcctcagcgacgaaggcgctatcgagcgcgtgcaacatgctgtgcaaggctgtgaaggactggtgtcctgcatcaccctggtaggggaagaaggcgaaatcgacttcgacccttgggaagggtaatgagcacggacaagcgtgtggtgttcagggatggcgtcgttctcggcgtcttccctgagatacctgagctaaaggaaggtgatgtcgtgtacgccaccttccacttcaccagcacagacagatatgcggagtactggtccctgtacacgaaaaaccagttgatctcttacgaaccgaccaaggatcaagccttggcggtcatgctattgaaggagtgacagatgagctttgtaagaatggttgggatgttggctgctgtgttcgctgcttacctcggtgtaaccgttggtgtagcgatgatcgtgatccacctgggaggctgtgcatgagcaagcatactcagtactaccttcaccgtgctgacggtgaattgatgggaccatcattgattgctggtccttgggcagatgtcttcaaaccaggtgacatgctgctggcccagaatcctactgctgcaaacgtgccttggatgtacttcgagctacgtggggagcattgggttcacgtaaaagagccgggggagcgtcaccgtctggctgcgctattgctcagtgacgaatgaaaaatggatggcagcatggggagccctgctgctgatacacctattactggagagttcatcatgttggcaatcatctgtggtttcatctttggttcggcttggtactggctggtgaaagagcgggtcaagttccgcaaggcggagaacgactaccgtgctggcctgtacatgcaccggtccaagttcattgctgaccgtaacgatgctgagcttggctgtgccttggctcttggcatcatgttcggtgctgtattcgtcttcatcttcaatcagtacatcggagcctaaaccatgctgatccttcaactggtctggctgttcctggtcttcgcagcggtcaccctctgggtttctcgtatggagcctaagcgaccttggggatggctgtggtggatctggttgggcgtactggctgtagcaagccacctgctggcaatggtggccgttgggattgtcgtgctatttatagtcccataaatcctgaacgattctcatttgggttacccagacctacggtcttgaaaggcaagatcaagagcaggctacgcctgtggaatggcaacaatcgccgacattcaatcacatgactatctggagaaataccatggcactcgtcaagaagaaccaagctcgcaacacccaagccgccgataacaagggcgcttcggcctacctgaacttccacttcccgacccgtgacggcaaggacgtccgtctggtaagcctcggcctgcgtgcggacgatgcactgcacatgcagctgcaagagttcctgaccgtggacgacaagggcaagccgctgagcgaaaccgcttacgccgagcgctgcaagaagctggtcagccgcctgatcatcaagctgggtgtcacccgcagcgaggaagagcgagcgctcgacctgtaacaccatgcccaacctcctcttgggggttgggcgtgttctttgtgctatccgtcagactgtaaggagttccaccatgaaacatcccaagcccatgtacatcaactcgaaggattcccgtgaacgtaatgccgattccgttgctgctgcaatggctctgcttcagcagggtactgatcatctgcctcgtactgaggttgcgtctgtctctgatgctgtcggcgccggactttgtagtatcggttctggcctttctcacctctgcgggaccaagagtgggaacactcgggccactcgaatctgaacccataaagtaaatcgtcgaattcggcagttttcggcgaggaaaaccatgtgctaacccatggttttggaggcatgaccatatgcatgaccacacagcttctattgcagtgctgctcgaagaactgaggcatgacgaagctcttcgcaagaagaaacggaaggaggatctcatccgtgatccgttcgcaaccacggagatctttctagacgatggctggagcctcaaacccagcaagttcaagaaatcccacgagacaaaccatgaagggaaggggccgcgtaacaagtacggaggtcaccgctgatggaagggaacgatgcagatgtggaagcctggcttctgctctggtccctccatgacaagtacacgaaggagggtttgaccaacccaaatctacagttgggggatttcgatgacggaccattctacgaggattacgacgagggcacagaagaaccggcatgctcgggcaatgcataactgggacatgcagcagaagtactggaaagaaaagctgaactacaaacactcatttctgaaaggactattagatgactcgcacctacctgaagaagatcgtgatccgcgatagcgatggcctgatcgtcgctggcgcagataacgtcctcgaagcaatgcgcaagatccccttgcgtcacctgaccaagcgtatgcacgtgactgacaaagaagaaggtcaccgctggagtctggtgtacgagatggacaccaacaaactgctactgacggctgaaaccagcgactgctgtagcatcaacatgcccataggagcactgatctaatggccaaattcgaagtagggaacatgtgggaagcattcgagagcgctgaccacttcatcgtatgtctgagcagcactgtcagtgcatcgggcaacgccgtcttgaacaagggcatggcagctgaactgctgcaacgcttcccggaagccggcctggcttcagccatcggtggtttcatcctgaagaatgggggaaaccacgggatcttcggcgttcaagccagtggaaagattggcgtgttgcagacctgccgacggttccaggatcccacggacctgaactgtgtcggtactggtttgcgcatgctgaccaacctggccaatgcgaacccggaccattcctatcacgtcgagatgcccggtacggatgtgccgtacttcctcgtgaaggggccggtggaaatgtgccctgacaacatcacgttctggagccgcccgtaagggcggttctgccgcctatagatagtcatcgttaaggatctgttatgcacccaactcacatgctcccggaggatatgcaacgcgccaatgagtaccgctttgcacgggcgcacattgacgggtatctgcgtaagtttctccaacaagatgaggactggactgaaattctgtctgctggtgttgctcttctggaagagtacgccaacaaggaccacggttatgagtccaagaacctccgtatggagacggttcgtaaccttgacctgagtcacatcaccactgaggtagcagttgcatcactgtactgtcaggttcctgagttgtttagcagcttcactgcgaaactggctcatgtacttggctttgatgacaaggctgacagcatcaaaaccatcgctgagatggttgcggtgctctgtgagctagatctgtacaacttggagcagaatgagcgcttcggtagctggaaggttgtgtccaacatcgagctacctgaagatctgatgcactttgttgaaagatcacagtacttacctcccatggtttgtgctcctgccaccttgaccagcaacaagcagaagcttcgtctcacttgtgaggctgagagtctgatcctgaatgacaatcaccatggtggagacatctgtctggatgttctgaacctggtgaacagtgttgagttgtgtcttaacactgaattcctcagcaccatcgaggaagaaccgaacaagcgcctggagaacagagatcaacaggatgattggatgcggttcaagactgaaagccatgagatgtacaagctcatggtgcaacaaggcaacaagttctacctgctgcacaaggtagacaagcgtggacggttgtacgcacagggttatcacatatcgacccaaggtgcgtcctacaagaaagccatgatcgacctctacaataaggaagaggtcactggcgtaccccaacatctgaggattaccaaatgagcaactacgaaaacggcgacctgatcttcttcaccaacgaaagcggccagatggagtgcaagctgatcctggacggcaagatctccaagttcctggaaggcaatcctgaactggaaggcatctggaacttcgatctgcaagcgaagcgctggttctggggcttcctggacaagaagaaggacaacgcagtcaccttcgaccatgcgttcgttgatccgccgaccatcggtgcgccggatgtatggcattcggttccgaaagaggtccgtctgatgaagacgctgaccatcgagaacattgccaacatgcaagctgagtaatacctgcgcctcccttggcttcggctgaggggggttccttttaagtgtgttcagtaccaactgtgataggagttacaccatgaagcgttacaccggattcgaatatctgtgcattgatgcagcaaaccagttcggccatgacaagctcctgttcgagcagcgtatccagtgggtaatggatcacttcgacgagctagaggaactggagtgcgaagagaagaccgcacctcagtactacaaagctgttcaagccatccgtgaagcacagaagggtattccctctggtcacttggttggcttggatgcttgctgctcgggcatgcagatcatgtctgcccttggcggatgcattgacggtgctcgtgccaccaatttggtcaacactggcttccgtcaggatgcttacagcttggttaccaccgctgcatccactgctatgggtgcttcggtaggtgacatcaagcgttcggatatcaagaaggccaccatgacccatctctatggttcgaaggctgagccgaagaagctgttcggtgaagaaacccctgaactggaagctttctacgaaggtatccaggcagtgtgtccgattccgaacgagatgctgtccgatctgatccacagccaccaggcttaccaggaggtacacgagtgggtactgcccgacaactaccatgctcgggtgaagtcggtatccatgaaggaaactcgtatcgaagtagatgaaatggacggtgctaccttcgaatacgcctacaaggtggtctgtggtgaagagcgcagcgtgaagaatgctgccaacatcatccacagtatcgatgcttacgttctgcgttccatgcatcgtcgttgcaactacgatcccgtggtgaccgagttcgcttacgaaaccatctgtgatgaactgatgcgtcgtgtcgttctttacgatgtggatctgattgaaaccaaggatgagaaggtgaggatctacattgacctctacaaccgtaccaacatggtggatgctgtcatcctacccttcgttaacacgcactctgtgcaagccatggagaccgatcacctggaggcactgaaggatctgtgcgtcagcatgctggctcacaagccgttccctctggtgacggtacacgatgagttcaagtgccaccccaactactgcaatgagatgcgtcagcactacatcaacatcttcgctgagatggctgacagcaacatcctcaatgacatcttccaccagatcactggtagctacgtgcagtatgaaggtgcctgtcacaacctgtctgaactcatccgtgatagtgagtatgccctgtcttaactgatagggcgttctccgaacgctccattgagttggatcttgtcttcccctgaaaaggggaaggcatcctttttttgagtaatctcaaggagggtttcactgtggttccagggcacgaagctttaatcttattgttagagagtgggtccgggttagacagtctaaagccaaatacctatatgcaacatgcatatttagaaattatccgaagaaacctaccgggggttttcaaccctaggtttctagctggttggttggagcactaccaccaacaaaagttaaggggagcaatgtgatggaagcagtaactggtcttaagttggttcgggtatcggtcgagtggcactactctggtatgttgatggacaagcatgctaaggaaggtgattggggtggtgtgtcctacttcgttggaatatcggacaacatcctcaaacaactgcccaagaccgttcgtatattgcgaagacaagaacgggaattttatgtgaaggtttgactatgaacactgagaaatattctaagcccggaggtagtctctttggaaaggctgtagtttatgtgcgctacggtcatctgaaagataagtacctcaaggagaggaatatggttgctgtaaccaggatctcccagaaaaggttgtccatgtgtacacaaccagtttactacctcatctatgatgcattggagtttctgaagaatgaagaacagtgaggagtatgaattaggtagggctatcttgtatctacaccttgatgaactgtctgctaaatacttcaaggaaaagatgagaaagcgttggggttacatgataggtgtgaagagtgaacttacccgtactgtaaaaaggagattcatggcaaaagcagggaggattgtccatgcaaggcagtaatctcggaataacccagcaacttaaggctcgcctggccttagaaggtgttgttgatatgaattcctggcagttatttgacagtacagacttctttttcaaggagatgcctggatcggaaaccatggtaaaggttcaagaagccttggccttggactacaccttcaacgcagaggtaaatacatatggtgtcagatgcagcaattaagctgatacatgaaagaatgaaggggaggaattacacctacacagagttattccgtgcattggctgagagagaattacctggtttaaacggaaaagactatgccgatgctcgttacaggtttattaagatggattttcaatccgttacaccttaatagcgttctccgaacgctttcatgctgcttaattcatttcgattagatagttttctttttcttttttaggagcaaagagatatgcgcaaatcctaccttctgtttctggatcgttccgctgcggtgatcggcattgtgatggtaatcatctctgccatcgtcggccaacagttgggcggtgaaatcttcggcctgctgttcgcactgggtggtgcccttgctgtaggtgcctccttcggactctggtttgtcctgtacgggatctacgaagaagtccagaaactcaaccaaaccaagtaaggagtaccccatgatcaaagtattcatccccttcctgaatcagtaccagcaagcacgtgagatccgtgtgctggaagacctgctgaagcagatgcgccaccgcttccacgatgcccaggacgagcgagacagtcttgctgaccgagttcacctggcctatggccgggcacagcaggcgcaggaaaaggtggaagaactggagcgcaagctcaagtctgccgagcgcctgagccgtcgcgtcatggaagccaacaaggaactgtcagaacaactgaaggacgtggtggccgagcgtgatcgctatgtgcaggaagctcaagccaagaagccgctgaccgaagatatggtcagtctcatgtccctggtcaacaccctgaagaacgcccacaccacggctcagcgggtgccaacccagcgtaaccatgagcagttcgtaatggctgctaccaacgtggcgctccaagccaagaaggtataaccaatggccagacttcccttggtttgggaggacgagattaagaccctggacctcgaaaccttgggtctgggtaagttcgaccaacctgtagcgaacatcgtggacattcgggcagacaacaagatgctcgatgtccagttcatccacaacttcaagctttacaccgcagtctactctcgggagtccgtatctaccctgaagcaagggcttccgaagttcgtggaggtaacccgtggccatctggtgaatacccgattcgtgatcggtgttgtccagaccggcccgaactattacctgcgtcttcgtgtgctggatgaacatcccatcatccagtgcagtcgccggcaaggtgagcttctgtacatggcttaccacaaagcgggtatcaatgcctacgaggcggcgaagatgaagtttggatgcccggtgaagatccctgcggggctgaactcgggttcgaacaaggtacgcaccggctacgtctatggcgtcaacggtgatatcaacacggatgcatgggggcgtgaatatcgcttcgtgcatctcaacgacattcgaggggatcacattggtagcttcccctcaaccttactgaggaaaacgtatggacagcaacaagatcgctgatatctacgaagccctgatccagctgcattaccggatctccaacctggaagacggcaagacaactctgatggagtacaggcaaagaaaccaagagtccatcgaaaaggtttattccactccccaggtcaatgcagcacaagctgcttccctctcgccggaagagatggaagaaatccgtgatggcttccaagccgtagtaacggatcgggataagctgctgaaggacaacagatacctggcggaagtactcgaatgtaagggtgaagaactcgccatcctgaaaaaagagcgagatgacttgctgtccttcaagatggcagtcactgtcaccttgggcatctctcaggaaacccacacgaaccacattgcccaagtactgaccagcatgaaaaaagccagtgataccctggccaaggtccggacggccctcaagtaactgaaaccaaggaggctacatgagccagtttcaagaagtacggcctgtagcccaggtgctgtacccaacctacgccacaacgaaagaagccctcgaagaagcaaggctcttgcttcccgagggcaaccatcacgacttcatgcgagcattaatgggttaccacaacaccctgctcaagtctcttcacgaggcttctccggctcagggggcatgttgaagtcgtttccatagccgaagtccaccagttcgaaagcacctggcggaatctcgccagggacagtcagatcaaatcagccaacagtctgttgttgtaccagtttgaattctggtgcagccattgtgtgcccctctctaatgaaagaaacccaagtctacaggagtttgtaatgaccaacatcaatgcaagtgcaatcgaatccatccgtcgatgcatgacggtacacatggagtccatcggaaccgtgcgaccgcacttcatcctcactggttccagtggtgcaggtaagtcgtacaccgttcaagccatcgcagaagaactcgaactaccgttcgtggagatcaactgcgctcagctgacgaaagaaggcttgtcaggtaacagcttggccaaagagatggccgctgttaaaggattctccggcgttcctacggttgtgttcgctgacgagttcgacaagctgctgatcgccggcaattccaattcggacctggcccatgaaagcactgcgggggttcagaatgaattcctgaagatgctggaatcggacatcaccaaggtctacggcgactacggcaagtaccaagaagtgaacgtcggcaaagtcctcttcatcttcgccggcgccttcaatggcgtggacatgaacaacctcgacgacctgcgtgcggtcggcgtcaagaacgagttcctgggccgtgtgcctctgcacttccatttggagaagccgaccctcgacgatctcctgggcctgctcaatcgctcggccctgatggagggatacctcgaactgttctcttccgtgaagcgcgaaacggcccgcaaggccattgccgaagccatcaagcaaggctatgacagcaacaccctgggcgtccggttcatcaacaccctggttcaccagtacttcatcgaaggcggcttccaagccaagaaaccttcgcagaagcggccggcccgttcaccccacaagcagccgctggacttctcccgtggcgcagcaacccgttaactgaaaccaatcactgttcaatctggagaacatcatgcacttcgacgaaactcagaaagtatccatcttcaaggccggcaatatcctgcgtcgctacctcaagtgcggcctggtccccatgcttcatggttcgccggcaatcggcaagtccgccctggtcaagaacctggccaaggagttcaacctgctggtgatcgacgaacgcctgtctcagtgcgaccccaccgacctgaagggtctgccggacctggccggtgaccgtgccaccttcaagaccttcgatcacctccccctcgaaggggacaagatcccggcaggctacaacggctggctgctgttcctggacgagatcaactcggcggacgatacccgtcaagcagcagcgtacaagctggtactggaccgcatggtcggccacaagaacctgcacccgtccgtggccatcgtcgctgccggtaacctggaaaccgacggtgccatcgtcaacccgctgtcctcggcgctcatcagccgcttcgttcacctgtacgtcgagcacgatctgaagtcctggctgaacaacgtcgctctgccgaacggctacagcagcgtcatcacctcctacctggagttccagccgaacgccttctacaccttcgacccggccaacgagggccagatctacgcagcgcctcgtacctgggagttcgccaacgccctcatcagcgacatggtttccgactccaacggccaagtccacaccatcctgaacagcatggaaaaccgtgttgctctggccggtgccatcggcatgggtaacgtggttaccttcaaggcattcgtggactactacgagtccgtaccgaaggccgaggacttgatcaacaacccggaaaccgtaccggtgccggaagacaaccccggtctgctgtgtgcaatctgcggcgctatcggcgagatcatggatgccgagaacgcggagcaactgctcaagtacatcaaccgcctgccggctgactaccgtgttgttgctctgaaaggggcagtcaagcgccgtggtgccggtctgatctccgtgccggccatctccaactggatgatggccaacgccgacaaactgctctaagccaaaggaggcatcaaatgggcaactactaccttgtggtgcctccggaggtttccgcagatgaggtgttcgaggacgctccctacaaaccattgggagagttcgaaggttggaatatctatgaatattacgaccgtttctccatcaacagacaccacctgcgagatgcggggatagctcatgtagttgggctatttccccatcaagtaggcacggtcactctggtggatgtgggcgtcgtctacttcaagagtgctacggaagaggtggagttgtaccgggtgctgtcttcggataccccggaatccacctacgaagcagcatccctgctcaagtaccggaaaaagctgtccctgggggaggccactatccggggtctggcttggggtatgaaacaccaaaccagtaactacaggttcatggaacagtaccgcctggggaaactctggcggatgaccaaactcatcacgggagactgaaatgagtagcttcaatgagatggtttcgaaagccaagatccggctcatggaacggcccaattcggtcttcctggccaacgttgcaatgcgtcttcggtatcaccaagacgacgagatgcccaccgcttacgtccaagggaccaagatgggcatcaacctggagttcttctctggtttgaacaaggcacagcaggaaaccctgttggctcacgagatcgggcacatcgtccgtctccatgcccagcgaatggaacaccgtaaggccatcgtgaagacccctggtggcggcatgtgtaccctgtggaacatcgccggcgacttcgtgatcaaccaagagttgaaggaatccaacttcgctccgttgatctggaaggacaagaacggcagggaatgcaagtggtgccaggacgacaagtacaagggcatgacgaccgaagaggtctatcaagccctgctcgaagaagccaagcagaacggtaagggcggtgaaggcgaaagcggcggtgcttcgttattcgaccccaatggcgatcccatggacgacctgcgtcccggtaaaggggaagatggtcaggacgaaggcgagatgaccgacatcatcgtagccgctgccactgctgctcgccaggccggtcaagccggctccattcccggtgacgtggccgtcttcctggacaacctgctgcaacccaagctgcccttggctgccaagttgcaacggttcttcacccgcttcaacaagcgtggcttcacctgggaacggcccaaccggcgtaccgcaagtcggtactacctaccgagcctgaagggcaaggcagtcggggatatcctcttctgcttcgacctgtccggctctgtgacggacgaggaggtaaagcggtacatctccgagttcaacggtgtcctgaagaagctgaagcctgaaagcatgcacatgctgactttcgacaccgagatcatgaacgtcaccaagatccgcagtaccaaggatctgctgaaagcgaagcttgagggtcgcggtggcactgacatcaaccctgtcttggcctacgtcgagaagcacaagcctactgccgtggtggtattcaccgatggcggtttctggcgtgccccggatcgcaacccaggtgtacctatcctgtggatgatccatggcaatcccagcttcaagatcgacttcggacaagtgactcattttgaggtctagatggtcgattttgaagaactgactcaaggccagaaggatgggtttgaactctttgccaagttttacatgagtctcgaacccatccttctactcaccggctgggctggcaccggcaagtctactctggtgcagcatatcctcagtgtgctgcccaagtacgaccgcctgtgcaagatcgtggatgaatcctacgtcccccgtgacgtacatctgacggccaccactcaccaggcttgtgaggctctgtctcacctgtcgaaggagtccggttacccagtctccaccatccattcactcatcggtgccacggttcgtaagaacctgaagaccggcaagtctgagttggcgctaaagggcaatgctgtacccgtagagaatgccctgatcatcatcgacgaagccagtcacatcgaccaacgcctgctgggcttgatctacaagcagaccatcaactgcaagatcctgttcatcggcgacaatggccagttgaccccggttggttcgcactacatgccggctttcgaagccagtaagttgatcatcgaactgaccgaggtcaagcgtcaggctactggccccttggctgaactgtgtactgccctccgttctactgtgttcggtggcccctggcccaagatcaagttggacggggaccagttgcagcacctgcctcgaaaccagtggcaagaactggccaaggatgcgttcaaggatcctgatacctggggtaacgtgaagatcctggcccataccaatgtggctgtgatcaacatgaacaactacatgtctcaggagatctacgggaccagcagaccgatggaaggccaacgcatgttggtcaacgaggctgtgatcaaccggaaggaaaccctcagcaccggtcaggaagtgatgatcgccggcctgaaagagaccatcgagttcgatatcgagggttacctcgtgaacttgaggggaagcaagggctgctacttcctgcccaagtcccgtgtggactacaaggcacggctgtcactggctcgtaagcaggatgactacgacactctccatgatatggaggggttcgtgattgacctgcggccatccttcgcctgcacggtaaccaagtcgcaaggctctaccttcgactgggtgttcattgatttggatgacatctgtaagaagatccaccatcccaatcaactggcccgtgccttgtacgttgctttcagcagggccaggaaaggggtaatcatgacgggggacatgtgatgagcagggccaatcagatccggttcaaatcactcctgaagacggccattctccggggcttgtacgagaaaccggagagggtctaccacaaccagttgctacagctgttgcagagagatgctgctattcgcggtgattcaattctctgcgtgcgcgtccgcgcacggttgttggcggttccgggagtcaagacaaaccttcgttcctcggaggtagttccgcgagcttccaagcagttgcttccggagtacgaggctctgctaaaccagtgggatcccatccttgtggatgagcaaacccaagttggtatgtacatcagccacgtcctgaacaagtctgacgacttccgggactacctgaagtgcatcccggatggtttacgcaagaacatttccagcgtctatgaagctttggaaattccaatggaaggtctgagcttccaggcagctggagacagtcttggcgcctatcaaccccactacgaaaccatgctgaaaagggttacctccaacctgttcctgtcggaggattaaaccaatgaagtatgttcagttcactgatgcccaggaaaggtatccggtggccattctcctcaaagaggatgctctacggaaaccagaactggaaaggaactatctgcccccgctgaagcaactcggggtgcagaactcggacgtgattgccatctccctggcttatgaagccaggggtaaggtatccgccaaacgtgtgaaggagtatctgcaagatgagttgctccccacactgaaagacctgaagactcggtatgtctactgtgccgatgctacctacttcaaggcactgaccaagcagaagacggaggccaactggggcaacgtacttgattgcgtatggccaggctacgaagacatcaaggtagtgtacgggctgaactaccaggtgctgatcttcgatcccggtaagcgggacaaactggagatcggcctgaaggtaatcgtagaccacgtaagcggtaggtatgtgcctgttggcgaagacctgctccgagacgtgacctatgtgtaccgagacgaggcagctaaagcgaaggagcagctgagcaagctcctcgataagccggaattaacctgcgatatcgaggggttcagtctgagcatgttcgactcaggtatcgccactattggtttcgcttggtcacagcatgatgcggtgcaaatccaagtggactaccaagaaatggcggaacctagtggtggcctgtacgggtactgtgaaaccaatgagccaatgcgggatgtactgcgttggttctttgaacagtacaagggccagttgatctaccacaaggcgaacttcgacgtgaaggttctgatctaccaactgtacatggcacacgacctggacaaggccggaatgctgcgggggttggagatcatgtgtcgtggtatgcaggacacgaaagtggttgcgtacctcgcactgaacagcacgtcctccccaagctatagcttgaaagacctagggcaggaacatgccggagattggtcccaaggcgatgacatcaaggacatcaggaagatcccgttggatcaactgatggagtacaacgcagtcgatgcggttaccacgatgtacgtgtggaacaagtactaccctgtgatggtcgccgagaaacaagaccagctgtatcacggcctgttcatggaaagccaggagatgatcatccataccgaactggtagggatgcccatgtgccctaaacgactggctgaagtggaaaccgaactgaccaaactgcgagatggttacttcaataccatcatgcaggatcccatggttcaccggacaactctgttgctgcgtgaagaagccatggtgaagaagaatgccaccctgaaaaccatccagaaaacgattgatgacttcagtcacatcgagttcaaccctggaagtggtccacagaaggcattgctgcttcataaggtcattggtttgcctgtcctggacaaaacacctactggccagccggcaaccggaggagatgagctgacgaagctcatacgccaccctgctggagcatccttcaagggtctgctccaagcaatgattgacctggatcgtgtacagaagatcctgtctgctttcataccagccttcaaggcgggaagactgaaagctgatgggatgttgtacctccatggctcattcaaccttggtggcacgatctccggtcggctgagttcgtcagaccccaacatgcagaaccttccgtctggttcagcctacggtaagttgatcaagtccatcttcatggcagcgaaaggctatctcttcgggggtgccgacttcgcagcactggaggaccggatcaatgctctgttaacacgagatcccaacaagatcaaagtgtacacagatgggtacgacggacactcaatgcgtacctttgcgttctggcctgagaaatgtgtgggcatcgtcgatactgtcgagtccatcaactcaatccagcaaaagtatcccggtctacggggtgatgcaaaggctccgcacttcctgctccagtatggtggtagtgcagcggggcttgtgaagaacgtcggcttctccgaagaggaagccaagaagatcgaagagaactaccacaaactctacgacgcaagtcgtcagtgggtagcctctgagatcaacaaggcaacaaaacaggggtatgtacagctggctttcggcctgaagctacgtacacccctgctcggcaacaccatgctgaacttgaaagtcacgcctaagcaggcagcagctgaatctcggagcgctggaaacgcagtgtccggtcagtcctggggcttgctgaacaatcgggcagcagtagctttccgtaagcgtgtactggcaagtaagtggcgggaggagatccacattgtggcgttgatccatgacgccatctatgtgctgttccctgacgatcctgagtgtgtggcatgggtcaacaataatctctgtgaagagatgtcctggcaggaagatcccgctattgcgcatgatcaagtaaagatcggtgcgaatctggatctcttctggccgtcgtgggcacatgcctgcactttggattacccaataactgttgagcggcttcaagagcaatgtactgcacacgcagccgcattgaaggagaagaagtgagcacctgttgggtcaacaaccacgagatcaccgttacgcaaggcgtcattgaggtccggcgtgatggtgtcctcgtacatgaatgtggtggcctctgggctgcctgcgactttgcacgaggaatcaagcatggcgaagaagccggaacccaggtcgatgaagtattgcgacctgtacatgtcgatagccaggaatgcggccaaccagtctaaagccaaaaggcatgtagtgggtggtgtgctggtcaccaagaccggagcactattcactggctggaatggaactcttcctggtgaagacaactgctgtgagcgtgggccttggctaagtacagaacagcggcacaagaccacgccctccggcgtaatccatgcggaacataacattctggcttgggcttccaggtcaggagttcctctggaagatagtcatttgtggatcactcgatctccctgcgtcaagtgtaccgagatgctgattacccacggggtaagcgctctcttctacgagacagcacatgatgaactggcggctttcaacctgatgcaaggccacatcaagtgcttctcctgggattcagtgattcatcacatccgtagacacggaagcaaggggttaaccgatgcgatcctcaaagactgaagaccggaagtcctattgggcttccttcctccatatggtccgccactttgggagtgtggatgctgctgagcatgccatcgcttccggcaaggcggtctatggaaaaccgaacgtccctaaaggttacgtgctaggcacggacatcaagggaatgtatgtgtttcataaggagtaattgaatcatggcgaagaagactgccaagaaacctacgtggacccccggtaagtacgggcatgcaccagttaacgggcggtacttcttcgttcatgaggaatcccgcatgacgcatacctgggtaatgggccaaggtccagtacccccacatttcaagcaggtgaccatggaagagtacgatctcttccgtagtgtcaccgcttcgttatcccgtaatgccagaaagaaactgctgtcgttgtatccaccgaagccagttgctccggtgaagaagaaacgtgtccgcaaacccaaggagtaaaccatgcaagtaactcatacgagtgatcggatcactcatgccgtcatcggcggcgaagaaaagatccagatgaaggtcaatgctgacgcggccttcttccacatgctgtcggataccttgtattccgataagcccatggccgtggtacgtgaagttctctgcaacgcctgggatgcccacatcgaagcggaaaacacgaacacgccgatcaaggtctacttctccgaggacaatgagttcgtcgtagaagacttcggcaagggtatccccaaggacaagatgggcgacatctatggaaccttgggtggttctaccaaacagaagaacgctgaagtcaccggcggcttcggcctaggctgcaagtcccctttcgctctggttgactccttccaggtggagtcatcccacgagggtatccgtaccatctaccgcatcagcaagtcctccgctgagcggaacggtctgccgaccatcaccccgatgctttccatcccttgcaacaagccagggttgaaggtgtccattcccatggacggaaaccaggtaagccggaacaccatgctgcacaatgcacgactggttgttcgcaatggcggtatgttggcagaggtctccggccaagtagttcctaccctgcccctcgaagaagccaagaacggcttcctcattgttcgtggctcgcgctcggacaacatgcccagcgacatctgtgtgctgtacggcaacgtgatctatccggtctcagatcatgatgactatgagcacctgtacgaggagtgtaaggactggcttcggatgtccggcgactacaacgccgtactggtactgaaggctcagccgaacaccattgaagtgacccccagtcgggaatctctctcgatggtctccacaaccaagaagacccttcatggtttgttggagaagttcaactcctacatgaagaacaacctcaacgcggccatgttgcaggtgctgaagcacaacaacgagcaggcattggcttgcgagcagtggggccgtctcatgcaacagggtgccatccctgttgtaaaccaggcttccctgaacgagttcctgaaaccaggggacgtcgttggggatactatcctcacggcagctggccatgctctctggctcttctcttactggggaccggatgtagtaaagcgactgcccaatggaaaagctatcctggcccgagatcgggttaaccggatatccatgcttcgcaagtgcccggatgtagaccaggttctcttgggtcagctgattcgtgtacaccgcaagtgcccgttgcaacgacctgctgacagcatccgcagctatgtgtctgcatccttccgcaagatcttcatgaaggacatgctcatgggtccggtgcagtcccgtcggttcgttattacccacctgcgggagatgactaccatcgccaataactcggactggctatgcactactgcactgcctgagttccatccgatccaaccgttgcttctgtattctttccagaagcggatcgtggttctcacccacagcagcaagaatgtcgaggagcgaatcgccaagcatccgctgcacagggagtacttcaagaagggggttcgtacccacttcttcacttacgtgactccgcgtagtgcgaagaccttggccgaggtacgaaaccacttcaactcgttggagaatgttgccgtcctcgacctgaccaaggaaatcgagtacatcccgcctgctgaacgggtcaaagccaagaaggtgaagatggacggctacgctaccctgcggaccgcccgtgcttctgactacttcagccaggagttggccaagaccggtacagaacaccgtactgacaatcccgtggccttctcgtacctcttctccaagtccaacacctaccatgcccggactgaacttcctggtttccgcgctgcggttgctgttcatgtcctgaaggtatggggtgaccgggttgcagtcgcccacagcatccatgacgagaagaaattcgtcgccatgggcctgcctaccctggaggagtatgtacacgcggagatgctgaagttcgtgcgtaccaacaagaagatcctgttgaagtacatgggttcttcgtgggcagcggctcagcgggtattcgaaccggacgatgagtacaattccgggttcaacatctgcaagtaccttctcgaaaccaatgagtggagggctgcactcggcttcaagacggaactgtctccggagttgttggctaaatggaaactgctgtgtgtctatcgggatagcctgcgtcggtattccactgcccacaaggagttggagagtgcttgtgagttcttggataccgcctcgccttctacaaaggttcgggagttggtgaccttgatcaaggactacccaatgttcaacctgctttgctcgaactcgaccaccaagttcctcaagcaggcggaaacgaaggaagaaaccttccatatgcttcaaaacatgctgaaaaggagtaagcaatgtcaaaagaaatctgcgtcgtaggtgcaatcctcgacgaaaagaacctgaccctgtacctcaagggcacaactgaaaccgtccgcatcccgcaaggagatgcacggctgaaacctgccgtggacttcctcgttcctcgcctgggtgctcccggtgccgaggtaatgatcgacctcgacaaggtggccaacgtcatcaaccacttcgaagaagtcgagaagaagtccaacggactggttcgcttcttccgtgtggcgaaggagaaggtgaaggctgcgctgggtatcggcgatgccagccaggaaccgcagactccggtccaaccctttaccgctggcgcggtcaaggtggacgctgcgtctgctcccctggctgtcgagaaggttgaaatcaaggacgagaagctcgcttccgctgtcgatgaaatcctgtcgaacgcacgtcctgcggtctcttccgacctgaccctgagcgaaaccagtgccgacaccgtggtcgccgtcgtcgatggcaaggtggtggctgacgcccagaagctggccactcaggtggttgcggtatccaagggcaagtccagtgccaagggactccagaagttcctggagcgagtcgccagcgtaagccatgagcgtcagcactccaaggacgacctgatgaagttcatgcagcgtggtgacctgccgattgcggatgatggctccatcatcatctacaagctgctgcgtcgcaccagtgccggtcacttcgtggattgccacaccggcaaggttccgcaacgtgtcggcagccatgtcttcatggacaagtccctggtggatcccaaccgccgcaacgagtgctccaatggcctgcacgtcgcccgtcgtcagtacctgggcaccttcagcggggacgtttgcgtcctcggtaaggtagccccggaagacgtgatcgccgtgccggagtacgacgccaacaagatgcgggtatgtggttaccacatcctgttcgagttgccggacgaagctcgcaagaagctccagcgtaaccaaccgatgaccgacgatccgacctgcgccaagatcctggccaaggcaatcgccggtgatcatgttggcgtactggagcgtgtcgagatcggcggccacaagggcaccaacatccgcgtcaccaagatgggcaatcagggcttcgacaagaagcagctgaaggccaacaacctggaaggcgcgggcgaagccaaggccatcgacaccgagatcgaaaccagtctcaaggcagatgccgtcgatgccaaggcggtagctcacgaggttgcctccaaggccaaggctgaaaccaagaaggccgaggctccggcggtcaaggaagctgctccgaaaggtaagcagaccctggccgagcaaggcgccgccctcttcgccaccttcatgaagaacccgaaggacaaggctgctgcacaagcctgcctggacttcaagaaggccaagaagaagggctgggttgttctgggaatgccggaagacgctgaaaagcgactgaagcgtaccctggaatcctaaccacatcgggggaggtaactccccctttctcacagaggtatctatgagctactgggaaatctatttggtattgggcgtctgctggttcctctatgagatagcagacatgttcgaaagtccgccgacgatggctcagttcatcgggaaacccccagcccaacgcctgatgatggtgtttgcgaacttcggtgtatgcatcatcatctggccgctgttgttcatcgtggcactcacaatggtgatctacactaagacgcgttcccgttagtcaactaaccgtttagtacccgtgtaatcaactcaggattgctttattatggcaaatggctgctactgagcagtgaacttgctggagagtccaatgccttggaaaagcaaccctgatttgtggggtttactcggtgcagtgttgatcagcctcatcagtggcttgatctcgctggcttctcggttggctaagggccatccactaaacttcttctgggtggtttcggagatgggggcggccatgcttatcggctacctggtctatgacctctatccgatctatcaagaagaacttccacgatgggcaaccatgccgatctgcgtagcattctcagcccacttgggcggaagattgttccagtggatcgagttcaaggtgaaggataaattccaaatccctgactccatctaggaaagacaaagcccctcttcggaggggttttttattgtctggagttccatcatgaaacagtcgtacaccgttgtattcaacaccgatgccgtagagcggttaggtgttttctttgaagccatgagacaggaggggatcgaagtatctgccctgtgccaaggcgattctattctcaaagcagaagccctcattcactacttccctgccgacttgtcagcagagatcgtggagggtttctgcaacaactttcaagccatggaggaatactatgtctcgcagcaagaagaaatcgtttgagatcatcaccaacatctcgtccatgccgatctactacaaggtggtcaatcacatcgtccagatcggcaccaacaagtacaaccaccatctccagctacagaagttcgtaggtttcctgcgaacccctactggttgctggtttgtgaagcaaagagacgctgctcgcgttggtggttgtgagttgcaatgtgacttcgataagaaagccactctggcctacttgaagcagcattgcgaggcgttctgggtgagcgagaacggtggccgcaaggcttggcctaccgtcgaagcggcactcaacagtttccgtcgccggaagcgtatgcacgtattccactcggaacaggcttacaagactgccatctctggcctggcttggactgactcgctcaccgacgaggacatcactaagctccaactgaccggtcagctgacccgtaacgaggaagatgcctgggaacccttcaagaaccagtcggtgattcctgttgacctcaagcaggtacagggtggtcccatcggaaccgagtgggatcccttcgagcaggtataaaaaaaccccctacaggtggcgacaagcctgtagggggttagggtgctttgaaacctatggggaaggagcggaccccacggaacgaactatcgcatagctcttctggcaggtcaatcctgctgcatggcttcggtcaaacgccgctgcgagttcttgtcgatctgcaacacagcttccgtacagttcggcgagcaccacagcggcggagttgcttgcatggcgctcacgtccagcggaggcaccttcggcaatgagttggtcacgtagaccggagacctggacccgcaggctgcgagactgagcatcagcagcagcaatgcgggaagcttgagcagccagttgctcatctgcatctttcttcacctcttcgattgcgttgagcatactttgctcaattgattttgtgttttcgtcagccgccttttgggcggcctccattcggctttcccaagcctcattggttttgcctactccttgggagtaggcccaccagcagaggacgaggatcagcagtgcttcgccaaaccatcggagcatccgaggggtgatcgtcatgcggtcaccgccttgactgctttcttgtagcagtcatcccagctttcgggatgaggtttgcccggacgccactgtgagatgtacacgtcccacagcttggccttctcgcctacagcaggtaatgccctggggtcggtccacaggagcagacgggcaaggccgcaagccagaacatcatcatgttccaaggcactccatacggcctcttcgacgggcttcacaccacaggcttccacgaagcgatgcactcgctcacgggtaacagcgttgtggtagttgagcagtcctttgactgccccacccttctcgaactgccagaaccccttcgcaggcccgagcggcaggagaaccttgcgaccctcggagttgatcgacatgatcagctgacgccgagaagcgaagcgagattcctgccctccgatggccagcagagccacacgggcagcagggctgtccatgttactgggcagcatggccatcgtggcggggatcaccttttcatgcacgagttggaaagtcatttcggttcctccggtagtgggtagcgttctttgatctcttccactttggcaagccaaagagaatagtccggttcggtaccacctttgatggcatcgaactcggcctcggtcttgagaggatcgctctccatacggtaagcctcagcacgattagccagtacagcatcgtactcctgcttataccgatcttcgatgagatcctccgctgtcttcatcttgctccagtcgatcattggggcaactccacgattccatctttttcgatgtagaccggcttagggaatttggcctcctcactgaagtctccccggatggggaaaaccagtgtgagatggatatcccccccttctctggtaataccaccagagaaggggccacccttaacagctgttgctggaaggtaaccaccctccggcaactgcgagaagtcgtattcgactcccgatactgtcacagaatccccggatacctggacagtcatttcggtcgagtcccccggaaggactacgagcggactcagcttgatgtgcatcagtaccatctccctacggccatgatcatgatagtgtcgttagccccggctgcctgtgcagtagcaaaagaaacagtgttaccactattcaggtaagccccccgaaccccttggccagcgttggtaggccagttagaagaggggatccagttgcaggttactgcggtattgaagccagaaacgaaagaggcaggcaactgtatcacattggcgccagcaggcagaccaggttcagttcttgcccctgccatttgagtcccatcagcgaaacggatgtaccagccgttagcagttgtgccactttccatgatggcaccattcggttccccggtgctgctgttggtagtagtcccgaccaactgcttatcggtcagatagcgtacccagggactccagacacccgcagccttacgacggaaatagcagatatccgaagtacgcggaatgaagatctgcgtagaagtgctggcgtcgtaaacctggtggtagatggtagaacccaccgggttaatggaagttacgcccggaggcaagttcgcccaaggggcaaccccgacaccgtagaaaccgcactcgttcggaatggcgttggcatcgctgtaggaccgcagactggtcatcgtcttcggagtaccaccgatgtagttcaacgcattctcgaccgtagcagcacccagcaacccgatcccggcagaaccggcgttcaagttacgccatgcaccactggacccagcttgcaggggaacaaccccttcataaccggcagcagaagccacaggcaagcggttgaacgcagtaacccgtggggtcatgaagctattgcgatccatccacttctcagtgaccacctccaccggagtttgccagacaccctggttgttcgaataacgcatgtacatgcggtcggaatagcattggttccagagttcccaacccttgttgttgtcgtaggacatgtgatgcacgaatgcatagatgtttcccggtagggggttagaagaatccccaggaacgtagtagtaaccactacgaacaccaccagctgccatctgagcaccggtcttattacgcatcgtcaggtcgccgtaaccgtagttactggtccagtcctgaatgaaggtaatgacgtactcggtgttagcgatctgcttgccgtagggcaggaaaggagtctgcgtgggtacggtaggaataccggtaaacgaagggctttccagcggagccaaaccattgatggaagtggagttcgagtagaactgtcccagcttgtcggcgatcttcttcgcagatgcagcagacagatgtagtccgtcgtcagcagcgatagcagggtcgaaataaccgtccttgcctaccacacgggcgatgtccagcacctgacccaaaccagtgaccttatgcagttcctcggtccaccattggtcggtgtacgccttgagcttgatcaccccctcggccaacgaatcgttgaatgccttggtgccttgcatggcgttgaacaggaccacttgagcaccaacagcgtgcagtcgatccacgatggcttgagtgtccgaggtacgcttggccatggtcatggtggcgtctttgtggtcgttcgtgcttgcatgcaagaacaccactttcacgccggagttctcgatctcacccaggctatccagatactgccaggtacgtcggccttctacaccttgcaccagaaccaggttgttccgattggtggcgtacaggttggactggccaaaccaggttcctgcccagttacggtggttgtgatattcctcagtaccacgggttacaccgtactcgttctgaccagcagcaatactgtcgccgtagcagatgaggttcggtcggcataccgtgatgaagtccacgtccatccaccacccattgggtgcaacaggcatggaagagatctcgatgaccgcaggcttgatcgtgtccaccatcaagcgaccaccacccttctgccaggtgccattgggcatacggcggaagagttcaatgtgacggttcacggcatcgaacttcactgccatgtccatccaggcttcggtattcaaaccagtgaacatggtggcggcattacgtgccccaccctcgctaccttgcatatggatggtgttcggttccaccaagccattggcattgatgttgaagtagaccgtgtagtccttgccatcagcagcaaggaaacgaatctgggccgagttgttctgtgcagcagtacccgtctgggtcttcacccggaagtaggtgatccagtgcccatccgggaactcgacagactttcgaatgaaagcacgggaaccggaggcatcggttttggaaatccgaatgaaaccagtgtgctgagacacattcaccggaccggttcgggtccagttgtaatgatcttcgccgccttcataggtgaaggtttcgttcatgcctaccagtgcaggtaggttgccgccttctaccttttcagcaacttggtttgccagggattcagcacgatcagcttctgtcttcgcacggttggcttggttggtagcagcagttgccgaggcagcagaaccagcagcggaattcgcggcattggtttcgctgaccttggccgcagcagcagaggctcccgccttacctacttcaacctttgcaagctcaacctgctgggcagctttagctacttcagcctgtgccttggtcacctcatccttggccttgacgacttcagcttgggctttaacgacctcggctttggccagatctacctgctcttcggcacgatcagcatggccctcggcttcgtcacgagcctcgcgtgcatccacgacagcttgggtgatcttgttcatggcttcctcgtcccacggcagagacgtgggcggaggcaacaggatcagttcctgcacatgaacaggggtaggagagtccggcacgtagaaggtgaacgacgtgcgattgcacggatcatcctcgaacgagtcgtcatccactacggaaacccggtaagccgaagtagccgactccaggtccatcgtgaattgaccctgggcatccgtggtcatgtcgtagctttcaggaagaacaatgcagtcatctgcatcgctcatacccggacgagtcagtcggacggaaaactcttttccggcctgtgggctgccatccgggttatggaaggtgaagatcaccttggtggtcatggttgtatcctcttcgaagggagtcaggagtataccaatttactgagatcgacaaacacaagcatcggcggacctccgccataaacactttcccagttagtactggacatctcattggttactccaatcgattgcatagcgatggatccttgccccccggcaagtaggcttaagccttctgcaagggcaaatacctccccaggttcgccgccatgaccggcaataccccgcttacccatccgagaagtggtggtgaccatgattccgcagttagggggaacggtgaagccgtgagcacccttaccgtaatcaggtacttggtgggtgctgtgtacccgaagatagggaagtcggtcactgaaagccaatttcccatctgctttgaatacctgtaccccagcattctgatttatagacatgtcagcggcagaaccgaagatcattatatcggcccaggcagcattggcgggataccactctgtacacaagccaattcgccaagtggtggcgttgatcttctgcctgttaacctccgcaacacgaaaagatcctccgcctggcctgtaggattgtttcaacacaattacaggatattcacccacaacatcaatgttgtgaatataagcaaaatccctggaaagcagacgaactgtcctctgataggccatgttgctgtaatcagaggtcgccatcagtacgttcccgttcagggaatagacttgaaaaccagcaggcattagaagtaccccacaataactcgaagtggctgacgacctacgttaactccggtgaaaaaccaggagactgtacgagtagccgggtcataactcaggtccggtgtagggtaaatggccactgaattgaattgatcaattactacacggttggagtcagctactgtgaccaaccatggagtccctgacccgaccgggatagtgaagctaccggaagtagttccggtagagaaagatgtgtagacctgacagagcctctcagtcatgtcaaaccagagtgccccattggaagtgaatgtctgtagtccggctggcatttaccaaacccccatgattacgcggagtacaccagcagcatcatagactcgtgtagccccgcctttgatgactgtacggccagaggtggcagtaccgttaagttcataagtaccgttgtcccagaacctccaaccttgacgttcggaaacccagttcttggattggatgttactaacgtcaatctggtctgcttcaaggtacttagcctgaatcttaccgttttgaacgataaggcttccatcctgtgccctcaacttgtcgaaggtgagtttgttgatggcaccctcgtcaatgtagacgatgttgttatcgatgatgaatggcttccgtttaacgttggcccggccaacccagaacctatccacatcgaaaccagcctcgatagtctgtccctggttgtacagaccgaaaccaccgaccagattgcctgcctggagcttcacgaagtactgagactccatgacagccatcttcccttcctgctgggtaaccttggtcaccaaaccaatctgaccagaggcagagttaccgttcacagtagagttcagtgtcgttaccgacgaagccagtgaactgacctgagtagcgagtgcctgttgctcggtttggatggctgcaatgttcccgttgaagtcggcatacatggtgttaaccgtatgtaccagagcaccatcagcatcagtacgaatccgtacttcttcttggagaagtgccagtgcatcatcagtctttgcaccaagctcagagatgcgtacagcaagaccctggtcattctgggcacgcagaagttcttcctgagtgatccccaacttgtttagttgaatctgatcgatctcagtacgaaggttctgtgcaagagcaccagcatcaatctgaccagaaaggatatccatcatctgtccaatgagcggtcgtgcagttgcactcgctggaccgatgacttcaccctcagtaccgttgatagagagcatctgaatccagtagtagtacctggtatccaagttgatctcgacatctaccctgtcaaagtagaagttaccctgaacaaccgctactcgtgtagctacgttgaaattcggggtgatacttctccagaggatagtttgactgaccgcagctgggttcagcgtaggccatgtccagttgatatcgatacccccgaaggccggagtagccgtcaggagtagattgttcatgttcggatcacccggtttcgggcctttccaagaaccagtaccgcactcagtaccgttcagattacatacgtctaccattgggaattcctcctgttttacccagtataaccctctccacctcctcccccctataccctaccggggtagtgcccccccgagcggtgagcgcagcgaagcccgagtgggagacacggactccggtagggtataggggtataggtaaatcaatatccctacccctcgacgggatccgtgtctgcgggggcgtgcggctgacgccgatcccccttgacactaccccgtctcagggtagggggagaaggtcaggggagagaccttcccagggtccacccgactcccggccccctccgggggcttgaatgtaaattcaagagggggagggtggacccctttatatataagaccgtttcgtgatcattttttaaccagaggttttacccatgaaaaagctgaccgcagccgacattcccgtcatcgatttccccatcgacagcatgcccaacctcaaggcttccctgggtaaggcacgcacagataccattcgcttccatggcttgaacaagaacgccatcggcggcccacgtacccgttgggtacagaaccctcatgcaaagcgcctccagagcctcgacaacatgtttgttgatccgatggtagaggatgtcctcgtgggcatcgcttcgctcgcagaaggctcccagaagcccttatcagccatgcgcctgttcagcctcctgaaggaaccgcagctgagcacagacctactggcttccggtatgtccctggacagccgacaagcccgtcgctacatggctgctgccaagctggccatctttcacctcaacaagcaaaaggagactctatgaccaaacaccctctgtgcaacaaccaccacagcaccacagccacctgcggcctctgccgggaactctacaagatgtcctccatgggagcggtctacgggatttccatccagggactcccgaaggagtacgtcgagaaggccaccaagcccaaggcggatccccagaaccgctaccgtcgggagatccccaaggagtggacctggcttgacgtgtaccggctgaacaccctgttcccgatcacctgcgacaactccggtgccatcgaccacgcacgcaagaagctgctcaacctgggccagcgaagcggcggcaagtcggttcaccaggatgtgaaggaagccagggattccctgaaccgctggttggaagataaccccgagggttaaaccatggccgctcgatataccaatgagacggggattcccctgtctatggccgtatggctggcatcggactactacgactattccgaggctggtttgtctgtgacgacgatgcttcgtccgatcaagcaaaccatcctggctcgtcgggtatccgaagaagccaaggtagaagatgtggctaaccgcatcaacagtgccatgggtaatgcctttcacgattccgtcgagaaggcgtggaccacaaaccatgacactgccctggctttgctgggctaccccaaagccatccgtgaacgcgttctggtgaatcccaccaaggaagaactggaaaccttcaactccaatgccaagggtggtaaggccatccctgtgtacatggagcagcggaccaagcgggagttcatgggaatcaacatctccggcaagttcgacttcgtaggagatggccgggtagaggacatcaagtccaccactgtctacagctacaccatgggcagcaaggacaaggactacatccttcaaggttccctgtatcgctggctcaatcccgaactggtgaccaaggacacgatgctcatcaacttcatcttcaccgactggcagaaagcaatggccaggcagcaaccggagaagtacccgcaatccagaattcaagccaaggaattcaagctcatgtcccttcgggaaacagagctgtgggtgcggaaccgggtgaagacgttgatcgatttgatcgacgcggatgaagacgatctgcccatgtgttcggacgaagagctatggcggtcggatccggtctataagtactataagaacccggccaaagccacggaacgcggagcacgaagcaccaagaacttcgacactgaagccgaagccttggtacgtctgcgtgaagacggcaacgtcggggtagtcaagaccatccctggacaggttaaagcctgtgcctactgccctgctttcactgtgtgcaagcagaaagacgccttgatcgcttcaggcgatctcatcatctaggagtgagtaatgctttcattggatcagatgaagcatcaccccacatccgagcgcatcgtcgagattctctgcgagaaaacccagtcgaagaatcacctcttcttccgggttctcgtagggttccacttctccatgatggccgctcaaatgcgttgctctatcaagacgcatgatcgtggggtaatccctgtcaacatgtacgccatcaacctgatgccttcgggcgcgggtaaaggcttttccacgaacatcatggaggaacagatcactggtcctttccgtgaacgcttcatggaaagcttcgatgcggcggctgaagtcaaccttcagaagctggctttcgaacggtccagtcgtaaggactgtgacgaaagcgaagaactcctgcgagtccagaaggagttcaaccaactggggccactggtttatacctttgactccggtacgccgcctgctgtgaagcagatgcggcacaaactgctcatggcaaatgccggtgcagtgaacctggtgatcgacgagatcggttcgaacctcacgggtcagatcgaagtgttgaacaccttcctcgaactctacgacgtgggtgccatcaagcaaaagctggtgaagaacacacaggacaacgtacgaggcgaggagatccggggcaagacgcctaccaacatgatgttgttcggtactccgaccaagctgctcaacggcagcaagacggaggaggagttcaactccatgttggaaactggttacgctcgccggtccttcttcggacttggcggcgaccagaagaaggttgccatgaccccggatgaggtttacgacctcatgaccagcaacaacaccgtccagttcatcgacgacctcagcgaaaagttggagaccctcgcggatccttccaacatgcggaaggttctgacgatggacaaggacacagcactactcatcattgagtacaagctgaaatgcgaagctgaagcagccgaactcggcgaacacgaggaaaccagaaaggcggagatcactcaccgctacttcaaggccctcaagttggctggtgcgtatgccttcgttgacgacagtccggtcctgacacaagaccacttctatgcagcggttaagctggcagaagagtctggcgaagcattcaagatgctgctgagtcgggaccgtacctacgtcaagttggcgaagtacctggccaacaccaatcgcgagatgaactacaccgatctgatcgaggatctcccgttcttccggggttccaagagtcagcgggaagagttgatcctgttggccaccgcatggggctacaagaacaacgtgatcatcaagaagtcgattcgtgacaacgtagacttcatccgaggcgaatcgctgaaagccactgatatcaaaggtaacgacctgatcgtgtcgtactcccgtgaaatgacggaagggtattacaacgacaaggtgacctgggaaaacatggcgaagctggtcggcatgcctggccttcactggattgcacaccacctcgctggcggttaccgcaacgaggagaatgcgattcctggcttcaacatggtagtcctcgatatcgatggcacctgcaagctggaattggccaagcagttcctcgacggttacaaggcgatcctctacaccaccaagtcgcacactgacagtgatccgcacttccgcatcgtgcttccgttgaactatcacctgaagttcgatgccaaggaatacaaggagttctacaacgccttggtcgattccttgcccttcgaagtcgatccccaatgcagccaccgctgcaagaagtggttgacccacgaaggtactgtcgaggtactggacggcgaactctacgacgcactgcctttcatcccgcgaaccagcaaggatgaagaacgtcgtagccgtctccaggaccagagcgatatggatcggttggagcgctgggtgatcaacaactccggcgacggcaaccgcaacaacatgctccttcgcttcgccatgattctggtggagaacggcttcggctacgacaccatcaagaatcgggtacttggtttgaacgccaagatgcaggacagcctggacgaaaccgaactgctgacgaccgttctcatcacggtgcagaagaagctcggggtttgaagatagggccgcttccagcggctctttcgattaactacagaggtgtctatgactcaagtcaacgacaacttgttcttgatctctggcgaatccgctaccggtaagtcgctgagcctcaagaacttggaaaaccccgaaggggttatctacctgaactgcgaagcaggcaagaagttgccgttccgcaacaagttcaagagcttcaccatcacccaccccgaccatgtgtacgaagccttcgatgcactggagaacggcaagctggaaggccacaccatcgtcatcgacacgctgacgtacctgatggacatgtacgaatcccaatgcgttctgggatccccggacacccagaaggcgtggggcaactaccagcagtacttcaagaacctgatgcaggattacgtggctcgctcgtcggcgaacgtgatcttcttgggtcacaccaagtcggtctacaacgatgcccggatgatgatggaatcgtgtgtaccggtgaaaggcgccttgaagaacaacggcatcgaatcgtacttctccttggtcatcagtaccaagaagatgtccttgcgtgaactggaaccgtaccgtgacggcaacaagctgttgaccgtttcgccactggaagagtcacttggtttcaagcatgtcttccagaccatgatcaccaaggaaaccatcggtgaaaggatccgtggccccatggacatgtgggaaacctgtgagactttcatcaacaacgacgctcagcttgtaatgcagcgtctccgcgaatactacgcgggctgaaataggagatattcatgagctttttcaacgacgtacaagacgaaggcaacatccaggaatccggcgacagcctcggcggcgctagcctcttcgactccaacgcctacgacctgaccatcaaggtggcctacggcctgacctcctcgaccggggccaagggcttggccttcgaattcgagcacgccgcaactggccgcacctacagcgaaaccttctacgtcaccaccggcaaggcgaaagagtgcaagccgtactgggtcgataaagacggcgagaagcactatctcaagggctacgagatcgccaacgcgatctgcatgatggccaacgaaaagggcttcaaggaccagaccttcgaggacaagaccctcctgctctgggactcggcggccaaggagaagaagccgaccgtagtaccggtggccacctccctgatcggcaccaaggtatgcctgggcatcctgaaggtgaagaagaacaagggcgtgaaaggcgaagacggcgtttaccgcgacaccaacgaagttcgcgagacgaacgaggtggataaggtattccacgccgagtacaaggtcaccctggccgaagcccgtgcgggcaagcgcgaagccggcttctacaacgagtggatcgccaagtgggctggtaacgtcaaggaccagttcaaggaagtgaaaggcgccactgctggccgtcccggtgctgccggtggcggttcccagcccaaggccagcagcctcttcggcgactaagccatgaaggtccgggaactgcttgaatccctcaatcgcatggtcgattcctgcgagggggatgaacgcgaacggttgctggaccatacactgcgtatccctgtgcttcgccccggtatgtgtggggcgaggtcagctgtggatgtcgtcagtgtggttcctggcttcgattgggacaacggctcaatgttcgttgaacccaagtcggacgtacagttaaccgtccttacacctgaacagatcaagaccatcaccgccagctatgccaaaggaacttcctggtttgcctatcaggaaaccaagaagctgagagacgagatccttcgcctccgacagcagttgaagatcctcggcggggacgagtaaatgcctaagatcaacatcttgggcatggatcccagcctcagtaattggggcatagcctgcggcaacctggatacctccactggcttgattgagttcaagcatgtcgaggtcatccaaaccagtaaaagcaaggacaagcaggttcgcgtcaactcggcagacctactcagggtcgagccgattgccgagcgtctgattgaacttgctccccatgccaaagccatcttcgtagaagtccccgttggttcccaatcggctgccgctatgaagagctacggcgtgtgcattggcctactggcgtacatgcgtgcgctgggctacccattcttccctgtcaatgctgccacgctgaaggtgcatgcgtgcaattctgctacggccagcaagcaggaaatgattgagtgggccacgaagaaacaccccggactgaactggcctcgccagaacggacgggtagtcgccagcaaagcagagcacatagcagatgctattgccgctgctgaggttggcctgaaagatcccacattccagcagctgctgaagctgctctcataaggaacgatccatgatcatcaccctgaaccaaaacgatatcgtcaagatgctgaccgacggtctggccgctcgtggcctgccggtagatgccaacacccacgtctccttctcggtcacccgcaagggcggcagcaacgtcaccgccgaagtctcgctgggcgaagagccggcagtcgccgaagaagcgccggcggcgcaagcggctccggtcgagaagccgaagcgcgagaagaaggtcgtaaccgaagacctgggcaacttcaaggctgccgccgattcgcaggccgaagccgcaccggtggcgaaagagccgaacccggtcgaagagatcccggctcaagccgaagccccagcccaggaagcgaccgcacaagaagcgcccaagtcggcagccggcctgttcggcggttaagcgacacgcccccggttcgccgggggttcttcccaaggggaaaccatgaagaaaaatcgatacctgctgtccttcgttacccacaccggtggcggcctccagttctcatccacggtctactcatccaaggatgtagtcattggcttcaccgctccgctgatcgcagagatcaaggccaagggtggtgtccatcaagacgcaatcctgctggccgtatcagaactcggcctcaccacggatgcagagttcaatcccccgtaccgtccaggtatggatgccaccactgcctacttgcagggtgtacgtgtcggcctcctgggggaacaaggcgaaaatccgtatcccgaaaactcggtagatgcggtggacttccgcaatggtcgcattgccgggtccagcatgcgtgaaggtcaagaacctccgcaggacttgagtccccagtaaaaagagtgaatacctagccttagtcctacaagagttccctgaactcattctctttttagccagttctcgtaatggtttggcttgtaggactctttttactgttgacttgcagtgccatagatagcatagtgatcacacacagcaacaaccaacgacatacagccacagtcaatggtgaaccagaggaatcccctcgtagaacttcctgtctcctagcctctgagttcacccaccctttcaagatagccagcttcatgctggctttcttatgtctatgtttcatagacataagggagtgctctggcccgttgtgaacggtcctccccacgccccgcaacggggtccagaccagagcactccacccttaccccgaaatactcaaaccaaggagtcccctatggaccataccaatgcactcttggaatccgcccagagcctggccaacatcctgaccaacggcagcctgagcggcattagccgcaagaacatggaaaccgccctcgacaccatcactgctggcttggttgcagtagcgaccatcgacaccaagctggtcgtcgagcacctggaagacgcggcgagtaaagccagtgagtgatcgtctgccccatgaccgtttcggcgtaggcgatgttgtccaggctatcgccgtggacaagaagcagcacacccgtgcgaacctggaattccccaaccagttgccccaagaagtcaccgaacttctggagaagctggacaaggcttgcctggcccacgaactgccctactactacgccttctccatgcctggcggcatcctctgccgcagtgacctcggccactacccgcagaacctcaacatcccgttcctcatgtcccgtgcatccgctgccggcgaccaggagcacatgatggaagtgatgcagcaaggcatgccactcatggctcagcgttaaccaggaggcccgatggatgccctaaaggtattcgtcggcgtctgcctcttcttcggcatgatcgtaggaggggcattcgtcgtttacgttgcctcatgggtcttcaggatcgttggattcctgtttgcagtagccatagtcctctgtttgataggagtcctcttctgggagatcctggcaaacgcattcaaaaagaaaggggagcattagctccccttcttctttaaaggttgaacaaacctttgatcgctggcagttcactcaaactgcttgggaaagcaaacggaccagtctggaatgggttgtgcccaatccggttaatccagctgctgtccatcacagattgcaaaccactgacgaaatggttggctactaccagtgccagaccacgggcaggcttctctttgaccagtcgtgcaatcaccttctgaatccgcaggtagtacttggtgaacatcagcaaaccagtgtcgttgagatactggaccatccgatgggacggaatgtcgtagttcacgaagctttcttctgcttgcttcagtgcatcagccttgctcagcggatcgcgagaacggttgatcagatgctcgtacagagtgtaacgggcaaccaagtcactcagctgagtggtttgcgacaggaacttgtacatggacgtgtcatgagccacgtacacgaacttagccgcatcacgcaccagtttcggaagcttactggttactcgttcagtcttctgttgcagcaaagacttgtagctgtattggctgtcgtcagcttcaacgtcttctacaatggtcggcatcagaccagcgtcaatcaacggcttgatggggttacgtgcaatgcgatcacgcagcacaacaatctcatcgtcaatcgacgcaacgccttcaggcacatacccaatttccttggcttgcaccagttggatcagacgcttgttgtctgcccgatactgcaaggcacccttaatgccagttgcatgcgcacgtactgcatcggcaataccaacaccgctccaagccagcaacgtcatgttcgatacgatgttgcccaccagagtgaagatgttcttcacaaccagaatgtccttggcttcacgtaccagttcctgaatcacgtcttcggcacggccaagacgcagtgcagccttcggacccaggattgcttcagctacagttaccagaacctgctgagcaacgttacgttcctggggatccaaaccaaacggaccagttacggatgccttacggtaacccatgatcatgttcagttggtcagccgggatcatcatgttgtccgacttccacacattgcggatctcacgcttagttgcatagggcaacaggttgtagagttcctgcaagtgaggttcagtgctgtccttgcctactttgatgtagctgctcgggcggttcgagtagtcctcacggaattgctcgtacatggaacgaactacgtccacgttctgttggtgcgaagacaccttgtccacgatctgaccagccagagtacccagtacctggtccatggagttgtcgcggttcagaagactgtcacggttgtgctcagtcatcatgtaccggtagtcaacaatgattccattcgggtccagtacaggagcaacacgttgagcctgtgctttacgcggatcgtaagtagcatcggtggtgaacatctcatcaaccgagtctgcaatgttcttgcggatggttccgatggtgttcttcgcagtacccggattgttgctcagcatgttcacagcagagcgctcaacacgggaacccttggcttgcataccggtgtagctcatagcaccagtcagcaaacctacctgaccactaccacggcgggataccagtaccttaccagcggacagaccagctgctttgtcttcttggacgttacctgcacgggtgtaaccacgcttcaggaagtagtccagatcggttgcatccactgccagtacttcgatcttgttgtcgaagatgtcaggggtgtaaccatcgatcatcagacgctcagtaccttcgaacaggaaggacttcgagcgatcttgcagacctttgtgcagcttcaggatcatctctacgccgttgtcctttccgcgtgcagcttcagtacgcagaacctcacgagcagcaaccttgtcttcatgactggtgtactcgaaggtgaacatcggcagcagaagatccattacttccttggcagccttggcatcagacttgctgacggacagagccttcttggttccgatcaggtcagcgatgttctgagtgttcagcatcaggttcgggcttacgttaccgccgatagcacggttgtaggccagatccttcaccgaacgcaggtagtaggcaccgttcttcataccgagcaactgagtctccagctggctgcgttctttacgcagttcactgtcgttgttcagcatctgacgcagaccgtcgaaaccataggtgtccagcagtgcagacatgttggtccgcaggaataccttggtcagtgcagccttgtccttgttggtcaggtactcaccgccatccttgaaggaagcgttcacctgagcaacggtgtactcgatgtgctgcttgcgctccatctcgttggacttggcttgcttgaacaggctgtgtgcagcagtcatcagatcggtgacgccacgcatctcatccagcacacccatgagcacaccacgcggcttacggaatgcatcgtcacgcagtcggctgatgccttccagtacaccatccacacgaccagccatggtcgtctcaatcagcgaaccagcagcacgaatgaacgggctgttgttgttcgtgaagaaggtgctctgcgaggcttgttctatggtgttccgcagggactcacccacattacccatggcttgttcgacttgatccagggcacccagcttacgctcggcaaaccgaccacgacgcttggcttcgatgtctaccagccgatccagcagggtaaccagacggttgttcgccaattcacccggagcggtcttgtcgtgcagacggcccagacgggtcagcagacgacggaacagttccatcaccttctggcttagggtcatgccagcaagcgcacgctcagtgctcttcgagcggaagcccagggcattgaacacttcttcactgccgatggccaagccagcaaaacgagccaggaagctgttcttaccagcggtggatgcctgaaccttgaacaggaagtcgtacttctcctgagcaatggccttctcctgctggctggcttgagtccagtcaccctggtggaagtcacgagccgacagggtatcgcgagcctcacgccacaggttctccagagaaccacggatgaacagaccttcgttaccgttcagggcggtgtcgatggtggcttctacctgctccagcacgaaggcttcttgatcgctgaccacgaaggcagacgacagagcttccgatgcaaacggcatggtgttggtgttcatggctttgatcacaacatcggtgttggtcagagcctggccttccatgacgcgggtacgcagggcacccatcggtccatgcagggccgcaacaatgttgtccagggcatcagccagacggttctggtgagcaacactgctgtctcggttcgaagccagtgcattaaagatctgcttggtggacatgcggttcacgctgtctacggcatcttcgtaacgcagagtcatggtgtccttcttggccatcatggcttgagcttcggcgaacaaaccagcggtgttgctgataagcagacccatggcgttctggttcgacggggtgttctcaccacggaagaccaaaccagtaagggcactgatgaagcgacgcagaccagcagtgaagcccttgtcacgtcccttggccgggagttccagacccttcagaacttcctcttggaaacccttgttggtcataccccaggaaaccagttcgtgtacgtcctgcacagcattggcgtacttcgaagacagagttccattggcattcaggaagtcctgagccttcgaacggatctcttccagttcgtcaaccatgcggcttgcagcagtgttgtggctcgggtctttggccttggcatccagttcacgttgaatcacccgaccagtaacggtatggagcagttcatgaaccagaaactcttcagtgatacccgactccacgaagtcaggggacttgacgtagatagcgtcgaagttgcccttacttgcataccaaccgcgtgctttgctcacgccttctcccagcgcaccgtccggaccggtctggggggtgaccataatcaccggcagatcttcacgggtcagtcggctcagggcagccagtagcttcttggtgaagccatcctgggtacgttgctccaggtactgggacaggttgcgtgcagtcacaccttcgctcgacaggaactcaacgaggtcttgctccgaaggagttacagcctgaccgagttcgccccataccgacttcaggctacgggtgctttcattgatggtggccaccacagcagctgcacggtcttccggaagaacttctttggccgaagccagaggaatgttctggttttccatgaccgaagctacctgctggaggtcttcccgcagctggccattggattcgcggataacgcggtccatggtgttcaggctggtagccggagccagagtctgtacggaatccgaagacaggggcttggccttacctgccttggcttccgaagccatgacttccaggttggcatcaacgttctcagcccagatctcggcttcctcgttgaacttgcctacctgtttcagggcatcctgagcagccttgcggtcagcatcggtcaccaggtagctaccaccttcggtagcgtactggccgacggcagccatctcgctcagcatggtgagcttgtcggtatcagcggcttcagccacacgacggatcgcttccagctgttgaccaacagtagccttctggctttccaggtacttctgcatcatgggagccatgacagcagcagcttcgggatcagccatcaggctgttgaagccagtcagggtacgttcgaaggtgtctaccatctcgcttgcagccgagtaacccagcatagccttgaaggtagcttcgttcagacgacgaccggcagcagccatgtcggacaaaccagtaccgtgagcatcgtggatgttcaggacgctggcaccatccaaagcagtgtggctgatgaaggagtccagtgcgtgggtagccgtgatgaacggagctacacccggaccttcgttgaccgtggtcatgccactggctttcatcgagttgaccgcacgcttgcgaccgtcgctatccaggaactccagcggttcagcgaagtgaacttcactgcggtacagcggagtgtcgttgagttcacgacgggtcttggccatgagcataccggcatccagttcaccactggctttcgagaaagcagtgtgcaggatcggttccatcggcttcagttcctttcggatctgctcgatttgctcacgggtcaggtcagtgtacggctgtccatccttaccacgcggcaggtcagcagtcttcagcatctgctcacgcttggcttggaaggcagcttcgtacatctggaacgccatgttggcggtcttgttgatgacatcacgacggctgatgaactcagcgtaagtgtcgttcagtgcctcttccactttcttgcccagtagttggtagaagctgttcttcagagcagctacctgacgggcatcaaaggtggtatccagagcagcttcgaagcccatatcggacggccacttctgtgcattggtcccgatcatcagctggtttacagcattgatggtcttacgcagagagtccagatcattggcattggcagcgtcttcgatcttgctgtagatggtttcgatgaagccatcagccataccgtctaccgcagtcttggtgttcgaaccaaacatcattgcggtcaggggctgcttgattaccttacggcccttggacgatacgttgccgtcatccgtgctcagttcaccagtgatggcttcgatagcggacagcagcgggttgttgcccaggatatccaggacagctttgatggtgccttcgtacaggtccaggttaccggcttcagcgtggaagtcgttgaactgctggaaaccatcggccaggctgaagaaaccaccttggttcagggtttcaaaacccttggcaccggacatgagcagcgacagcatcggaccgttggtcacgccgtccacttcacccagcagggtagtcttgaaggaagcagcaccgtcttcacgggcgatcttctcttgagccagggctaccaaaccatcaaggctgaagaagttttcgccggcttcagcaacggcagccaggatagccgactcgttggcgacggtatcgttcgcatcaccacgaaggatctcagccaatgcatctacaccaccctgaattgccggggtgttcacagtagcatcgtacttggccagaaccttgtcggtgttggtggcttcagtcttcttgccgaaggactccagtacacgaagcttgaagttatccatgtcagctttcgaatcgagtttgatctcggattcccagccttccatcttcagcatgtgacggtggatcttcgaggtctgtgggttgatcaggttgctggtcaaaccaacacgctgaggcttccacacagagcggtcgaagtacagaggctgttcagtacccagatcggacacttcgttgattcggttgaagaagtcaccgaagttctgaatctggcgaaccagtccatccgacttggcttgcagaccagcacggtttgccttgtgaaccttggttccttccagatcggcagcaccagcaatggtggccagagcttcaggactgaggttaccccatacctgccacatctcaggacgcagagtgtgagcttgcttcgcggccttatccaggatgcgtgcttgctccgaactaatcggctgctgagtacgcttggcgttacgctgcttgaagtcgatgggttcgaaactcggctcgatcatggcaggagtcgtaccgaacagcttgttcaggatcgactggcttcccatggtagcttcacgcacacgacgagccagcggaccagcctggagcttgccgtccacacgttcgctgaccggagtcaggaagtagtgctggacttttgcgttgggcttctcctgcgaacccatcaggttcttcagttgagcatcgctgatagcagtgatcttggcagcaccactcttcaccagcaggtgcagagcatgctcacccagagatgcttcgagacgagcttgctcgttcaccggagcattggggagtacctccaaaccaaggacttcacgtaccttggcacccagctgagcagcagcagttgcctggcgaacaccgacagtggccagagcagcgtaagcagccggagatacttcggcactggcgtctttaccgaggatggcattgatgcctgcatcagagttcaccaggttggaagctgcatcgttgatccagtcgtaggcagcataggcgatagcagtgctgacgttctcgtccagggaaccatcagcgttcaccaggaactgagcatagtcccggaaacggtaacggctggcatcgccagacttggagacgtactgcttcaggttggcttcaaccaaaggcttggccatacgctggaagcccatgaagttcttcagagcagactgttgctgaccagtgaaggactcaacgccagcaaactcagccagcttgacagcaccagtacggacagcggtagcgaagtctttcaccgaagccagcggcttcttggtgtcaccttcttgcttggccggcgattgctggaagaacgcaccaacaaggttggtgtcctgatagtcctggcttgccagtggcttaccacgaacttctgcaccttcacggattgcagtcagttcaccagtttcgacctcgggaacaggttccgcctggaccgactcagcttcctgggcaacagcctcttcggatacctgagcggtaggctctgctaccggggtcacctcttcagctacaggagcaacttcttgttcctgggcgatggtttgctcttgagcaacctgtacagcgttggtcagaggaccggcgttgatcagtgcttgcagggattcagcagtgcgagccagggcggtagcttccatggctacagcatcacgcagcttctgcgaaccggcgaatacacgcagacccttggccgactgaacctgacggggagtcatgccttcaggagcaacttcccacacaccagtttcctggttcgggatgatgttgatgaagtcctgagtaccctgcaccttgtcgaaggcatcgctgattgcagcgaacttggacaggcgggtatctgcgaaggcacgcagctggtctacctgagcggtagcagcttcgatgttcccgttggacagggccatacgcacagcattgcggtattgagggatgcccttgaaaccatcaccaccgacttcgatatcggtacgcacaccggacaaacccttcagttcatccatggcttccttggcttgagcgaagctgcgaagtgcagtgcggtattccggggacagaccgttggactcgtccgaaaccatggaagcaatctgctcgttgctcagactgtccgggttagtcatggtcagggtgatcacacgctcagcagcttccggagaagtaggtgcctgggcaaccagttcttctacctcgggagcagtaggcgcagcatcggtatgcagacgctgaatcgcttcacgagtagccttcagacgctggttcagttctttgagttctgcatcatcctgagcacgcagttcgggagtgtaggcagcagcctcttcttccaggttacggatcgactcgatctgagcttccagctgagtacgctcttcgggagtagcctgttccagttgggcttcacgttgttcccgtgcagcaaccagacgagcaacaccttcttcactggccagagcctggacactttcgatatccgagatctgcttagccagttcttgttcgatggtatcagcctgggcaatgacggactcacgtacttcaggagtgtcgttcttcaggacttgttcatgcagcacactcaccgcaccagccgggttgtagttctccgactcgatgttggtcaggtcagcaatgtcaccagtctcacgggcagtggctacagcttcccggtcagtgatggcttgttcagccttggacttggcaccggatgcaccacgtacagcacggccagcgatgttcagggaaccaccgacagccgcaccgatggctgcaccttctacgatctcttcgatgctcgcatcgtccaggcgaacctgggcttcaccgtaggtctgataaccttcggtcacgccttcacgggcactggaggaaagagtcgagcggagcaaaccagcctcaccacggataccccgcagcatgctcaggtcgccgacttgttcagccattgccagggaagcagcgaaggcacccatcttcaggcgatcttcttggtccggcagttgaccatcgttggcttcagcgtattcgcgatagccttcacgaagttcatcagcggcgtagcccacgttggtggccacacccagaggtgccgacacagcagcagctgccagttgaggcgcgttctctacggtgtactcagtgacagcagaggggttggtggcagtaccagcaacagcaccggctacggtctgagttgcaccagcagcaccagacaacagagcatccaggatctgaccacgttccagttgttcaccagattcacgcagcagagctacaccctgttgggtacgctcagcaatgtcgcgactcatgacatcacggtcagtggtatcgacaatcgaagagatatcgaagaagtcctgaactgctttaccagcgtcacgcagaccctgaacaccgatcaggcgatcacgcatggtctgttgaacaccgtcttcaccagcagcgatctggttcaggatggcatcgtcaccttccagcgggttaccggtgatctcccggttgtaagcttggattgcttcttcggaaacaccagcctgacccatctgagcagcgaagttcaggggcaggttgaccagttgaccggctacacgggaagtacccgaagccaaggaagcagccaggttgatcgggccagtaccggtagcaccgggagtgatacccatcttgcctacccaggactcttcgatgttccggcgcttctgttctgccatctcgtagatgttgaactgcttttgggttcccttcatggggaaggtgttacccaaatcagcgaatgtagaaggatcgaaggctggtgcagtaccagcctccgcgtccaatctcgcatccaggaaagaatcgagatcaaagtcagccatcagaagttccttttgagcaatcgatcaacggtgtcattggggttgatactaacaccctttttggcctttgccgagttgattactctataggcattacccagtttgtcattttccagtttcgtcatctctttcaagaagtccgaccgtacggaatctgcatcctgagccatctgctccatgcccttgttacccaagagactttgtaggttcttgaggtaactcttcgcatcgttccggatccaggaatcggcatcggtagatgcagcagcagcggcaatcaactgggaaggaaccacgatcttccggccaccgtcggtagtcataccgttggtggaccattcgaccagagtatccgcaaccagacgacgttccgattcaggcatgccagctttacccagcttctccaccgtcttcgtaacgtcttccagtggagtcttgctcggttcgatgaacgggttacgagcaacttcagtctcgtagttgcgggtcatctgcttctggattcgatccaactcagcattgaccgcagtcacctggttctccgcctttacagcatcttcaggtgccagtgcatccatgccttgcatgatgtccagttgcttcgtggctcgctgaatagcagacggcgaagcaccagactcacgtagggtcttgaccaaggcttgcttctcgttggtcgccgacaagttggccgacaaaccagaggactgaactgcctctcggtagctggcttcttgatccggatccatacgggacacatctggcaaaccagtgtcatcagtgggaagtccctgctctttgccgatatctcgcaacagagcattggccgtttcccggctttccctgaactggttggagatctccattactgcactgtcggccagcttgttgtcgttccgttctcgtgctgcgtcctgacgcagatcacgctggtacgccaagttctcccggccagcggtcatggacaactggtgagcttcagcagcacgatccgcagcagcctgggcacgttgttcaccggctgcccggtactgacgttgcatcaggttgtcttggacacccgccagttccttacggatctccccttcgttgatcaactgacgttcggccagaatggcgtccacatcacgaccacggccttgagcagccagagtgcgtagctcatctacgacaccacgctgttctacttcagcctgctggtcggcgaatgcctgttgagcaacagcatccttttgcagggtttgtctacggttgaggatcgcatcacgggttgcggcacggtccagacgcatgcccagggcatcacgttgacccgccaaaccagcgacgaaatcaggatcttggagttgactcaggtcagccgaagcaacctgatccaggtagttttgcgtgttggcttcacgctgtacaccggcattcgccacggccatctcttgctgttgcttgatgatgtcgccgagcgaagccagtgcagattggacaccggtagtcccggcagtcagcgaacgagcactgccggggcttaccgtggttccaatgttacgccaagtgataggcggcattagcgaatccgattccgttccatgtacttgtctacggactcatacgcacctgggttagaagctacccgagcacgttgacggtcctccagttgggtgttgatcgactggcgctgagcaccgaagttcagatcgaattgacgacggctctctgccaattgatctcgcgcaaacttctcctgacgcttgccggcctgcattcccaagagtgcttgaccgataccaagtgcgggcattacccatccaccggtacgggcaccggattcggagacacccccgaacatggattcttggttgaagaatccgccgaagccagacatgagattcgccaagccctgggcaggagcagcgtcagcaccgacgttgatgctcggcatctgaatgttggtctggggtccacccaaaccaaaggagccaagagtggacaggtccaactcgactccgaaggggttgttgctatacggatacgccatagccattcacctcgttgatggtttcattgatctcagggagggtgagcttggttgcaacgaagtgctgtgctacatccaagctagccgcccctatgttgccagtatgaatcgttcgctggaagaagtctcctggggtttcccctgggatgatcgctggggacatgtgcattacgtccaacggaccgaggagtggggttttacccaaaccaagttccttagcagtatcgtccagttccgccatcatatcatcgaaagtagacaactctgcggagatgtctttcatcaactgagccatctcagcttggaagtcttgagaagcagtcttggccatgttcgaactgatagccatgaggttctcactccaagtggcttcggtgctcataccataagcgcttactgccatcagaagtacagcagccagcaagccaagttcagcacctacggtcttcacaaacaacttcactccgtagtcgatggcaatagcagtgacgatcatctgtagaacagtgatggccaatgcggtagccccaagtgcagctgctgccatgatggtttgccatgcctggcctagggtgaacacggttaccacgatggccactgcaatcaagatgatcttgaagaaggaactggagtaccagggtgccttgatgatagtcaaagtgttcacgcacatatgcagagcgcgagcaagcaacttctccttaccccgtacagacagctgatccactatggctttgtccaaagggaacagtagctctttagctcctggtccggctacgtgacctttcttatgagtaacccgatagtgcaactggggattgaagatagtgacttcttcgtacacagcatccagcacttgcttctggtatcggtaagcaggttggatagtagacaacaacccagagctattctctgcggtcagttgtttacctgtgaatttcccgactggtgctaccttgccagtcttccgttcgaacttgataccagaatagctgaagtccattccaaagtacttgtcttgaatggcgatcacctggtccaaggcattggaataatcaccgaacttgtcgggcaacccctgtgctttctgtcgttgcctgattccattgtgataaagccaggcacagtactcgaacagatagttctggtcatactgttcttcggatcctggattgacccccatgaacaggatggattgctgaacatcttgcaggttggggtccaactgcacggcgtccatcaacttttcgtaatcagcacccagatagcggcaccacttcttacagtcccagaatgctttagccccctgggcttgagcaggtagtttgttgaagtggaaatacgcccatgggtagtaagtgccagcggcttcatacttgatggtgaatacaccgtcaatgtcagggtaagtaccgcttccttgcttgtaggtgaagaaacctacagtgccgttattacgacggaacctaacttgatggtagtcagcttccaggtccatggtcatgtttaggcgatgagtacccttctggataatcccattagcgtctttccactcataggtaatcagcacatagtctgtcccatcagcggactgcttgtaaggactctggtttgcatactgccccatgcctccaactgtgttgtagggccgggagggggtcacgccagacaatgggctgaagccccagttctctaacaaaccaagggtgaatacatccttattccaatccagagtatcctgggaatagtaggacactgcatcataaaggaatacctgcccacgcccagcttccaaaccagggagtctgttggtgatcgggttccattgccacagacggatgcactcggtgtaggcccagtgaatggagttcagtgccccgtaattgttgtagtaggtagtaatcggaccttcacttctggcgatggtttgagcaacgatctgacgtgcatcaatgccactgaggatcttgctctgaggcataccccagaagtagtcattggactttgcccagttgtacccaacatctgcacggatacccagacttccagaagtctgttccagcatgtattcgacgagatcatcaccagccatgattcctttgatgatccccgacttaggggaatcgggaattgatgcctcttcgaatacacgttgcacagtggtattcactaccaccttcttctttacactgaagattcccataatcgcctcatgaaaaagggggaccgaagtccccctagtgtacacctaactgcttatgcccctgcaccagagaggagcttgttgatagccctcccgatgttaggatcgaacaggccgttggtctggtcggccacggtgccttcgtcagttgtacgccgaacgttccaggaatccaccaggatcttcgcagccttctgctcggcgtctcgcttgaagccttccgactgtgccaggtacagagccttctgacgaccgatgacggaatcaggatcagtaccggaggcgacggtctgtgctcgttcggtattggtcttctgctgtaccagtgcagtctgtgcagtggtgctcagcttctgttccatggtcaggtcgtactgggccttcagcagacactcctgggcaaccaagttgagcagttcctgtttcgcattcaggatctgctgggtcagctgttccgcttgcttcaggatgatcgcgttctgcgataccaagttcttggtttcctggtccacacgcttggtggtcgcctgcacttgcaggtcttggaaaccttgactggtgatctcagcatccagcttgcggatctgagcagcaggcatcttggtttgctcttgggtcagcaggtcttggaaaccagcagacttgatctgggactccggcagcttcgcctgttccagggtcagcttggtcttggccttgatcagttcagcgtcatgctcttccttcaggatctgcttgtcgatcaactcaccttgtttctcggtgagcttgatctgagcttcgatcagggcagccttgttggccgcttcgtccttctgaagcaggaataccacagcattctggagaatggctgcgatacctgcggaaagaacctggccgtattcctggtctttcatccgacctttggaacgttcttcagccaggtgattccgcagtgcctgcatcagctgatcgaacgcaccttcaccggtgatcttgacctcggtcaagtccttcagtgtgatgggttgggcagccatggcttactccttaatccagcgtgccgcgagcggcttgtgcttggcgcaggtcttccagttccgcagcggtcagcggcggcaggatctcgacggcgaactcacgcacctgcttggaggtacggtaggtcttgccggtactcggatccttggcgttgtagaagtgctggtagttgcgggccttgatcatgttgagcagggcggcttcgacgtgccagtcggtttcgaacggaacgcagcgacgcagggtgccgacgacatcgttgccgaaggtgaagatctcgctttcccattcggtcttgttcgggttgtggcaggtgatgcggcagcggacgagcttacgtgcttcgttacgctggcggcgcttacgctggttcggggtttcggcttcttcagcggcagcggccagggcgctcggctgcgggatggcggtttcggacacttcttcttcctcgtctacgatggtttcgccttcgatggcggcattgaccatggcacggagcttgtccacgccggtgttggaacggaacttcagacccagttgggtcgcgcgctcttgcaggacttccagttcggaacgctgcggcagagcagccgggtcttcttcggtcggatcttggacttcgttgttcagggcgttgtcgagagacatggtttgattcctctgggcggagttaaaaaaggggaggtttccctcccctccagcctaccttacaggcgggctacggtcttgatgagcgcgatccactcggggcggtacaccatgaagccgtagtaccacttgatggacatgaagcccatttcgccgtaaggatccaggcggtcagcggtcgcttcgccaggcttcttgttgtagatcttgaacttgacgttcttgccatcggtctggaaaccaacggtggtgaacgcttcggacgagatcaccagcatcgggaagatgctgtacttgtcgttgaagtcgtggtagccatcggcagccggatcgactgccttgccggcaccctgccagtgcatcatctgcgggttgatgatgatgcggaactggtcgattgcaccgatctcgccgatgaaggtgttgccgccagccgcgtacttctcgatggagatgaacgccggattgccgtggttgtccttcatggctttcagggtcgggatcagttcgctaccgcagtacagcggacggcagcccggaatggtgcgggtgtcgatcatccgggtaccggtgatcatcttggtgcccttcggggcgcggttgttgtccaggtcgatgttgaggcgcatcagggagtcgtaggtgacttccgtggtggcatccacttcgctgtcctgggtggctgcgcccggataacggacgacgccggcgctgttgagcaggtcgatctggagcaggtcttcggtcatctcgttggcgcctttcagcatctcgcgaccaacgtgcatgtccagttctgcatcgctatcgaagtccagcgactcctgggtgtactcccggaagaagccgtacttttccagcttgccttcgagcaggacacgcttgaagccgacgcggttcacacgaccgccgacttcggtgagggtcggcatcttaccgacgatggtgcccacgtcacggctcgaaccgtagaggttgccgttggcgatggtagcgccggaagcgtcgatgccctggtcgttgatgttgcggtcgtcgagcagcgggatgtagtgcatgcggacgatcttcttgccgtagtgcttcggcatgccgaagacggaagccagctgaccgaagtacgcttccttacgagcgtcgatcagcgcttgcttcatccagtactgggtctgcgtttgcggaccgatgctggactctaccccgcccgcagggtcgttgtacttaccgggcttgtacggatctggagcggccattgctcattccctctttcagttgcagttcagtgaatatatttgaagtgttgtgccgaatgcttctcgaactcttcatccgacatatcaagcgggttgtagtttgcctgagttttacgcggagtggaagaagaagtaggagcagctgcacgtttacgcgcattaacagccgcacttgcaggtttagcaccagcagtagtgaccttaacaggagcagcgggagttttaactgcctgagcattggccgcagcttgttcgatagcagcgaaagctccttgcttctgaagttcttcaccaacttgctggtaaacctgcaagtacggggcgttgctaactcgcggatccagaatcttacgacgagcaacttcggcatcgataatatcgaatacgccgttactcatctgactctccatataacccagaatagcagggttctcggaaagccacttcttggactgcgagtcgaatgccttggcagtgttaactacacgagtgtagtgttgcgaatgttggatagcatccagtgcatccgacattgcctcggcaaccggatcgatttgaacagcctggggcttatagccttcgactttcttctcatcgatatccagcggatctacccctgcacttttggccaacgctgcaatagcttccggcttcttgtgcttgagcaaatccaagatctgtcccactgcttcaggagatgccaggttggcgtcctccaactgtcgcagcagagcgagatgcggcttgagtgcctgcatcttctggttgtagttggcacccatctgcatcagacgttgtgcctcctcggcgttcttcacctggatctcgcgaccattggctttgaacggagcaaggatcgtatcacggaacttaactacgtcctcatcgggagtagctacttgttcggttttcttctcttgctctttgccttcggactcgtcggcatccgtaacttcggattcggctggcgcctcctcctcgttagcttcgccgccttcatcctcggcgggttcttcttctccttcttcaggggtgttctcttcacccaactgctcgccgacgtgttcgtcatcgtcgtcttcttcgggttgaacttgagcttccagttcggcttgctcttgttcttcagcagacaaaccagagggagcaggttcctgctcctcccggtctttaccgtccgcttcttcgatctgttcgcgtaccgattcgaactcggggagttcgtcatccggcatgtcgaggaagtcgagatcagccatggttattcacccgcctcttctgcttcagcttcggcttccagcagatcacgctcgtagatctccagagcgcccttggcctgttctgcacgacgtgccaggttcatcaggtagtcgcggaaggaagagatggcttcgatgtcacgaaggttggcttcggccataccttggttggtcatgtcgctacgactgtggaccagtcggatggcttcttcttccaggtagccatgactgaccacgagatggaagtcactgttccggcgaagacgttccagtgcttcacctgctttgatgtggtcccgcagttcctggacactgacttgaatttctttaatggtcgagttcatctcatttctctctggttaagtggacagagccaccgggtaagggtggctctaatatacatagttagattatcgtttggaagtcctggctacagttgcctcttcattgcggcggactatggaatccaagagtcttccctgtgcttgtgcatcagcttgtaccctcgtcttctccaattcgcgttcctgagttacaccagactcacgttcaacgaagtccagatctgcgaggtctgcttgactacccagagcacgagccttctgaccttcggtgccagctttgctggtattgaggtaaccagtacttgcagcttgatgagccttggccagagtttcttgaacctgtgcttcgagcagagcaacttccagttcagctttacgctgggcaatcggatccggttgcggctggtagttacggatctgatgtgccaagtctggcatcttcttcagttccgcaatctccgccaggatcatctggttcatcccccattccaggttcggacccatggtttgaagcatgaagctcaggtcggcaaccttggagttgtcttcttcagcagtgctgatgctcaaccgcagatcgaactcaccggcgagatcgtcacgacgaacagtaacgaatccttcgttggtgatccgaatgacttcttcgtcatccaggaactcagcgttcatcgcgattacgcgacggcctacttcgatcaggcaatcactcagccgacggagaatacccagttcccgtttcgatgcagcatccagagcgccacgaataccggtagccgtatcacccaatgcctgaccagagatgccggtgttgaaagctttcacaccagtcatcgactccgcttccagctgctgctggttcagcatgtactcagcagatcgcggaatctcctggaaggtatgggtgtagatcgcagttgccgggttgttccctgggttgaactcataggtttcaccccgttcaaaacgccgacggttggtgatatccaatgcacccttctggaaaccaacctgaccattggccgattgggccatgatatcgatcatcccacgggagatggcaccgacgatcttctggttgtcgatcagcagagaaccatcgctgtcaccgtacacactgtctttcacaggcaggtatgcagcaacaacgtaggggatcttaccgtctgggaacgggttcagttccagacgaatgaggatctgacctacccaagttgcgacaatagaatgcaactcgccgtcaccatgaatatcgtaatatccccaatactcatgaaccacaagccttttacgggagcggtcagcaaagtcgaaattgtgaacactctccgacccagtggcgtagtcaggttgggatagaatgtcagaggtctgttcattgatcttctccaggttcttgtatcgaccatcagccttcagttcagcataggagctttcgaaggtttcaaccacaaacttcgctttgttcatgtcaccgttgcaagacggatcgataacgatgttgcggaagtcgcataccttcagggttggttggttgactacagtcttctggaccttcaccttctcgctaccgttcgggatagcgatgtagggaatgccgtcactttcatagttctcgaaagcgacgcgaagttcctcgggaagttcgggatactgggaaggactctcagccttcagctgagcaatctcttccatggtttgaagagcagtctgatcctcgtacagggcataggtgatcttcacctcttccacttcacgagtcctgaagtcccagccggtcttgacgattgccgtaccttcgttcactgctgcacgaatgaacgtgtcgatgaacttctgcttgttcaacttgttgttgaactggtagttcaggaccatctggttctgacgtgcggcttccacatcctcccaggtaaccggctccacgttgaacacgttgggactggagaggaacggttcactcagggaagcatatcgccactcggcctgcttacgaatcagcttcggctgtacctgagatcgacctttcggtgccctggctttaccttcaccagtggcatgcatgtaatctagccactgcttgatcttggagatctgggcttcggctacttgtttgccatcatcaaagtcctgcttcaattgcgacaggtttggggcattgctccaatccggttgcaacttggcaggcgctgttacctcctggggaggtagctcattatcttgattcatcatccactccaaaggagatcaaatggaaattaaagcgctgtgcgaggactttatcatgcctacccgtggtagtgataccgcaggtggtttcgatatctacatgccggaggccggcgaagccaagatgaacacggacaaactcgttccgttgggcttctctacggctatcccgcctggcttcgtagctctgctgcttccccgttcgggagttggagccaagatgggtgtacgtcttcgcaacacctgcggggtaatcgacgctgactatcgcggggaatggatggcgaagatcctgaccgatggcccggacttcaaatgggagaagggtgatcgtgtacttcagttcgtgatcgtcccggcctttactccggaactgcaactggtggatgaacttcctgaaaccagtcgtggtgaaggtggcttcggtagtaccggcaaagcctaaaagaaaaaggggaaccgtcctggttccccttcacccttacgcccagcctccccgtcgcacaggatctacaaatcctagagatccattgtgcaaacttagtgcctccagattggcacactccgactcatacatccttgcgtagttcactccttcgagtgcagtgttctccatgaatccgataggagtctggaaacgggacgcaacgaagtaggtcagagcttgtttgtgagtatagggaagatcaactggaatgcaagcccagtcttccatcacatcctcacatacaatctgacttctcggtgctttcctgtacttcaatgtcaggtgtttgccaggaatgtacgagaacaggtcgggatctatctccaagatgttgtcttggggaaaggtaacggaccaacaactaccagtgttgatatcgtactcccgtccatgacaatccttaacagattccaccttcaggatagaccgagggaacagcttgtcatgttccatctcgatatactgaacgatccctggtttggcacggttacccttctgcctttcaggaaccaagtgataccgataggtatccttcagcatctctacccggatagtaccggtcttgagatcgaatctcttgtggagttccaagactccatcgttcacagcccttgcgatcttcggaatgaagatcggattgagcttgtgtgtctcgccatccaccacatggatgttggacagctggaagtcaacgagttcgttgaccacctctttcagtttgaaagtcataccagatagctctcccgccaggaatatgattgctcttcagcttcgctctcccacatctgcccttcatgtgagtagtgcattggtgcctcttccgaaggtgggatgggattcatcagagcaagctggctcacagtatcgcatacgtcgtcatgcttcgaccggaaaccagcaggagaaaccagactgatctcctccaggaattcccgcatccactcgtgactcttgaagccaagagggaagaacatcttcgcagtcttgaagaaggggaccatgaccatgaacctttctaccttagaggtctgagtagaaggccgtagacctggggtgcccttgttgttctgcgacgccaaggtgaagtacaacctccggttgttcatttcggattgaagccagggaatgaaacctgcctgctgtccggagatctcgatacccacactcatgggcctccacttttgaaccagacggaacaggtcatccacgttcttgtccatcagctgccgtttacagattccgtctacccagtaccaggactggtttgcagccagtgcccagacactgatcacactgtagtcagccgctgtattagcagacactgcgaagtccgtagtgatgtagaagttgaagttgttcttgttccgggtaaccgaaccgtggtcgtaccactgcaactcgttgtcctggatcaagcggtcttcatccgacatgatgcgaagcatcaattcctggttgaacgtgtcgatcttccctgccttgagtgcagcctcgtacttcttcttcacgaagtcgtaagtgaagcggtcaggccatgcaccacggaaatccttctccgagcaggggaacttctcgcacacaggatagacgttcaccttccaggcaccggactccactgctttgtatagaggatccttggcgttaaacggtgtacccgaccagatgatcatgttgcgggttgggtgcaatgcgtagtccaccgccttgtaaaccgtgtcttcaatagacgcgatcacggtaggggagcgagcatcttcgtccgaaaccaggtcatcgagaaccgcaagctgcggtcgcttacccatctccttcgcaccacggacaccagtcttggcaccgtagcctttgacgatgaagacgttcccttcgatgttgacgaacttccaccgaatgtcagtgaaatctgtaccaccgccgggaggcaggaactgctgcaagaaagcactgttctcccagcggtactccaagttcttccgcatgttcttgaccccgttatcgatggagtcggatacatacagagcaaggtctaccttcccgaaaccaggaagatcaccatagaccccaaggtacaggaacaggtactcacccatcagagtggtcttggccgcaccacggaaaaccatgttggcgatacgacgttcaccactacccacttggtcgagcattcggtaatggagaaccggagtcttgttctcctcaccttgcccaccgttcaccagcttgatgaactggacaaactcgatggcgaacaaaccaggagtgtaaggcagggcatagtcatagcagacggagttcaaccacttctctactgtgggtgcctccttctccatctccgcttcggcgtagtgatcactgatggctttgctcagtctgtctacgccgatgttgaagatgttgtcatcttctacattcattgaatgatctccgcatcctcagcttgttcgaacacaagcttacgttctgccgcttctcgtgcagtgatctggttgctggagatcatccgctgttccatctctgccagtgctgcaacgttggctcggagatcctggagcagagacgaagtaccagcagacacatcgatctgtagcttggtcttctccggtgccttcaggtgagtcaacagactgttggctgcttcgcaccgaaccttctccgaggtagcagtcatcatcagttcagcctggacgttgatggccttctggtagatatcagcattcagaacgtgagtcgggatcaacgtctgttccagaatcaggttcaccagcttcgacttgttgtacgcactgacgtagctggcaatgtctttcgatgcatagttctgcatcgtccaccgctggatcttgtcagggaaagtccggctgaaagcatcaatgttcgtgcagcccatgagcttgtggctcacgtacttcaccgcatggatgtacccatccagcttgaacttgccttcgttcatcacatgcgtgtagcccaacaggttgtcccggtaggcttcgcacatgtcgggatcggcgagcatcccattcagagtattcatgatctccggggtgatggacccacggagcttctccggcaaggacttcttgaattggtctgccgtcaactgagtgatcggctgtgcaggtacagcagcttgagtcatgatagaacctcggttgtgtataggttgaacctagcataacacacagaccaaaccaaggagatacacctatgtcaatcgttaacctgacgatccccgaagaagacctgattgagttcgttcacttcaggtacaggaggcggaagtattttaaggaggggttacgtctaccccctttagctgactgcccctcagtggaacgataccagaacatgtatggtggtttggtcggtgacgctgccacagtactgtatgtaacagcgagggaacgcggctatgttaagtattgagaaatcagctgaactgatgtaccggatcattcatatcaacaagctgtccaaagaaagccacacattactaacaaacaagctctacgataagttcatgctcgacctagatgccctggctcctttgtgccccaggtatgagatagtgaactatatctactcactggacgtgacctcagcatgactgacgatgaactgatcaactgtctcgcaccttacttctgtacccgcaagaacattggtgtactggctcggaagtacagcaaggaaaggcgatacagtgtagttgaagacctccgcgacaaggcgagctatctgctatcggctttgatgcagaagtacggtatccgctacatgaaattcaggagtttagaaagtgcctactttaacaagaactgaggagagatctctgtacttgaggatggctggtttccgcttactctacacagaggttcttgcgcataagcataggaaggaacgtcgggcctatggccgtgacgcctaccaacaggaagccgtcaggcaagagcagataataaccaacaacttcttccatggagattggaaccagtccatcagactgttgcgggaattggacaaggagggactcaatgtctgaccccatcccaagaggagttctgatgcactatgcctacctgaccttgctcagtcgaaaggctaccaaggaaaggaactgggaagagtggtacagcatatctggttttcaggtgtcgctagagaagtgtcacaacttcacactcaaccactacgatctacgtgaagtcatgggggatctatcaacatgagcggcatttggctgtaccaaataaaagcagcagttggttactgctatgggagagtgttggagaagaagcacctcaaggagtttggctacgcagagcctaacgactacacctctgaatatgtccaggtactgtcgatgcatgcctctgaatccctgtggaaggaggcatataaacatttgaggaactaaaccatggaagcaacgcaacaccactacacatatgcattcagtagtttgttgatgcgtaagtactttaaagaatccaaccggactaaagcattaggtcttcgcaacaggagtgtccagttgttcctcaaggcagggttaactggcaacttcccttgggtagagttgtacagcaagttggaaaccatcgtatgaataaagacttagatcctgcgctactaagtagtaccttcacacgaattctgtcttctaaatacaacaaggaacacaataacaaaatggctatgctactccatcgtcgggttgcccaagctatctggcctggctttgataaggctaattgggaccgccactggatcatagcgagggcaatcgtatgatgagtatacccaccactgtagtgcctgggactagcacgcatgatgagtacttgctccatgtagctacctccctcaagtatcagatcctcctggaatccaagaccttcaaggaacggataccactcagagaaccagactatccaacccactcacaggtaacagcagatgagtgggtaaccgcatggcaaagcgcagaggtacggacatgacccctgagcagaaagagttaatgctcgtctccgcattccgttacttcatggacctcaagcacatgaaggagaagatgtatcgccctaccaaattctcatatatccctggccccgatctaactgatgatgactgggaagaggtagatcagttagcaaaggaaatggtatgacctatagcaagagtgaaaccgatgtagccaagtacatgcacagtaatattctccggactaagtacttcaaggaacatttcatgacggggtggcaggccccaccgtacccttatgaccataacctgggcatggatgagtggaatgctctacgtgacaaagtggaggcaatggtatgaacgatgcaagcacccgacatgctgacgcagtagttcgttatctcttggcccaggagatccaggccaaacgacgaaaagaaaatctgccctggattaaatcgagggttgcgtatccagagagtaactcctatgcagagaacaactggactggatactgggaactgctgagggcaacggtatgaacaaacaagcgctacatgaaacctgtcaacacatgttcaacctggtgttgaactacaagtatatcaaggaaggtgtcccttcctatctccttgaagtaagtgagacccccgaatccctgaacgtactgacaggtggccaatggttccaggtgtgggacaaggcaaaggagatggtaatgcggaagggctacatatgacggacacctccgaaagcttgaatgaacacatcctgctactggcttgtcgctatatgtactccatcaagcgtgaagccaagtacctgaaagagaacctactcattgaatacagggttgtacccagcggtctatccgacaacgtgggactctataaaggagtcctgtgggcagatgcctgtactaacctaaaggtgtaagcatgaaaccaagattgttacgcacggtgtatcgtcacctatataacatccgcttgtacaataagcacaccaaagaagatttctacggtactggtcgtatgttcgagaaactgactgccgacttcagcaagataagcaggcagggagtgtcttacgatgagtggaagaagttggatgctcatgtggatcaattgatatgaaaccagtagctgagatccgcaggtatacgttttaccgaatcgtatactggaaagcccgtaaagagggactgcccagtaccgggggtatgttccgcgaagccaatgccacttacttcgagctaattgcccaaggcttttcgcagaagagtatagaagatgatcggttccttgtaggacaaatagtatgaaaccagaactaaaagacgacttcctcagatacgcgtttaaacgggttctctacaggaaagcccacaaggaaggactgcctgggactctgtggatgtatcaagatatcaactccatcttctctaacctgagccgccggggcgtcacacgcaaggacttcgaatccggatgggaactcacgagtcaaatagtatgaaaccgggatatgaatttcatgaggtggtttacgccacattcacaaagatgctgatggacaagtacaccaaggagagcctggagactcaagccagtagacagaggggtatgatctgggatctcacctggggactcagggttaatggtctccctcaccatgaatggagaaccgcacgtaaggtagtaatggagatgatgtaatcatggttttagataaacgagcagtacagtatgtgttcctccggtctctgtctgacaagtactggaaggaggaactctcgtatggaatctctgatatccagtacaagataagccaactacttcggtaccagaaactaaaagcagaggaatggactaacgcacaccaatatgtggagaacaccgtatgatagtagacccaaccgcatacgaggttgcctttctttatctgctgagtgccaagtactacaaagagaagcagacaaacaaaggtgacctccatcgtgaaacagcataccaattggaatacccactcaagttcagtggcatgaccgtaggtgcctggtcctgtgtatgggaccacatagaggtgatcgtatgaccgagatagaggctgcgcaccaggtagtgtttaactacctactaggtaataagtacaagaaggaatacctaataaccgcttcccagaaatacactgacaaagcctggggtattcagtgggatctccgtacacacagctctgtctacatagactgggttaaggtgtggtcaacagcagaggcaaccgtatgaaacccgaaccagctgcttacgagtgtatatataccttggtcctaagcgataagtactacaaggaagaacaactacccgtagccaacaagctattcaaggaaggtagccaggtcatggatcaactcaatgagcaaggtacttcctacttgcagtggtcccaggtatgggaaacagtggagactctcatatgaagaacatcggcacactagacttggcacactcttgtgcatacctatcgttactccagaggaagtacgtcagggagcgtctgtacgcccagagatcggatcttgcagataaggttctggatagacttctggaactaaaggccaggagattcgacccagattcctggaaggggatttacgatgcagcaatcagaacggtttgaaatcaacaaggaatacaaaccaggtgtgtgcaaaagtctgtactacaccatgctaagtgataagtacatcaaggaacaccagttcgtccaacacttcgataccctggtttattacaggaaccttatcgattccctaaaagccagtggtatgagagaccttgaatggggcttactactggaccttgcaatagaccatgaagtgaaggggtgagcacatggacaaagaagaactactctacgataccgcatacatggcactgcacataatcaagtaccgcaaggaatcccagtatgtaagggagaaaaccttgggtactaggttcaccgatatgatcatctacctgaatgaagatggcacattggctgaccactggaagcgggtaatggattcagtggagcggcgggtatgaagaagaacttcgaaaggcagatgggtaactgtgtgtacctctacctcctcagtgataagtattggaaggaaggttgcttaagccaggcagagcaagcactccgccagaagactgtcctgctgagatcaatccagaagagtggtgttaacgccttggaatggtgtgagatgtggtctgaggtaacggacactatagaagcagagaggggttgacttcctatggttgagcgtaagagatccttaatgtgcaacgttgcatacaacgcactcctcagctgcaagtacggtaaggagagcctgtgggtacagaagaataaggtactcaagagacacaaagaactggatcatgaactcaaagccaaggtgctaggtgatggtgagtggattaccctgtgggatcgtgcaatggatgaggacgtaacaaggtgacgtatgcagtatcaattgaaaaccgctgtatataacagtgcttacactgcactgctcagccacaagtatggaaaggaaggactctatttcgaagaacacaagttgatagacaagtacctggatactacaaaactcatccgtaagacccgtggcttcactgactatcaatggtatgtcctctgggagcaagcagtgatggaggtgagaacaatacagtagaggtgacgaatgaaaacagtagtgaggattatcctgcggaagagtgtgttcgcagccatactcagtaataagtgtgataaggaacaactattctttcaggcaggtacacacatccgtgagtactcaaacttactgagagaactacagatgcatggagtaggtggttatggtagttccacactctgggatattgtagtcggtgaggttgattccatagtgtaggggtgaagaatgaaaccagaagaaatacaggatagagcagtccactactccttccgcaaggtactccttgataagttactgaaggagaagtcatatccaccagagaattcctacagggaactctactctatcttctgtgatcttcggtctgatggggtaagtatggaggactttgaagcgggggatgagtacctacagaggtgcgtatgaacgatgaacaattagtaggtgctgtggttactcacctgcacaagaatatgttgtgtagtaagtatgccaaggagtcgtgtatccaatccctgaaggctttagaaacagccactgctggatcgtatgcaagccttaactccattgatgtgggaatacatcactggcagaaagcatgccagatcatgtcagattacgaagggtagatcgcagtaggggaaattacctcacagacttacggaggtagaaattcgctatagggaaaaatctataatgacttacgagggtagtacttcagtaggaccatcctcaaatccggtactcccccccggtggtgttcccctattgagttttccgcgcttgcttacctctgctggccttcggccttggggcggatgatcgtccgaaccacctaccttctactactctggagtattcctcatgatcgctgcattcaacgccttctttgccttcttcgctgctctgttccgtggcgctaccaaccttgccgaggctgctgagaacatgtctcgctatgccaaggatgaatctgagttcttcaacgagaacgctgaagcttcccgtgaccgtcgtcgtgtcgagtctcgtgctgctcatgctcaactggtacgtgacctgggtatctccgaagacatcgccgagatccaatccgaacgtcgtaccaagcgtgtaactggtaccaagtcctaaccctctagcctcactccttcacgggagtggggcttaactctttcaagcacacatagagcacacatcaagatcaagagcacacacctactcccttcttcctgatactcctctgcgtctccctcttctccctttggacagttggttgtaggaagtaacctttccctcttcttagtcctactaatcctgcttataggggaaatgatgagaggtttgagtgactgtgt

SEQ ID NO: 6 - DNA, 45703 bp, Podoviridae Bruynoghevirus
  misc_feature (1)..(45703)
ccccaggagtcccccagataaagtgggggtggcctatccacaggggtatagcccctagcccctccctaggataccatgggattagtccgggggtcaacccttagacccttgggctaagccccctagagctaccgttcatcgggtggacactagggtattcataagaaaaatcttagggtattcaggaggtggatcggggggaatatcccttgataaccccttgaccccctattgacttccctcgataccatatgttaatcaaagactgtctatatccgggggtttgctgaagactgatagtccatagactgtataaaaaaccagtagacaaccccgtaaggaatatggcctaatggctccgccttgaaggaaaccgacaggcaacgggggaaacccctaggggcttgacaaaccccgcggaacctggcctaatggccaccacgttccacctaggccaccatcctccaagtctacggacattaacgggggctgccaaccaaaggggaatgcccaagtcacccaagtataagaccggcaggcatcgggggttgacaagggataggggaagcggtaagatggctcccaagtcaacggcataacgtgcatgactccctcgggattagcgtagccttgacaagcaagactgatggccactcagaaaaagagcctatgccggagaaccggacgaactaacccccgtcagagggttgacaagccaagcccgaggctctaacatgggcacccattaggtgacggccaccttgggaaagtgtaccttcgacggtccttggactgaacaagggagaaacccgaaagctgggggaataacgcacactccggaagagcgtaggttctggccttgtaccatagaaggtccgactggttgcctgctccagcgtaaacaattagcagagttcccggtagaatcgtggggaacagtatgatgggttagtatcgtcggcttagcaacgagggcgaagcgtggtagatactggcgaaggtaggggcgagggattcgaagacccccgaggatagccagaggacagaccacaacgaggatactaacgcggaaaggggccggctacgccaatgccaaggtttgccgactaacccctttatcgtatcgtagtgtgtgctacggctgatgattccaaaaggatgaaacgatgaacgctgctctggataagaagctgcgccgcaaggctagccgcaaggctcgtgctcaaggtctgaacattgggcatcttggcaaagctcagcagcgtgcagaacagaagttcgggatcatttccaattgtaacaagatcctggatagtaagtttgcttccctacaggaaaaggccggggcacgcaagcgcaaggctctgatgaataccgattggcgtaaccgtgaggatactaaactgcgcaattggtacaagcctagcaagtgcaagaactcccccgtcacccacatcaaacccgaggtataagttatgagcgactacaagcgcatcaacggcatcatcaagaccatcgcccagcgtggtgcgtccctggataagctgatccaaaccaccggcctggatatcctcaagcatatcgaagagcacggcgaggtttcgctggcatgcaagctgttcaaggccatgccccaggggtcccgtcgcaacgccctggccgcgtggttcatcgaccacggcaagatcgaggccaatatcgacaaggaaaagtccaaggaattcccgttcgtcatcgccaaggataaggccactcgactggagcgtgcagccgaaaagccctggttcaagtacaagaaagagcgtgacgtggccgacgagttctccctcgatcaagccatcgccgccttcaaggccaaaatccaacgtgccatcgacaagggccagctccaggcagctgacgagcgtatcgccgtgatccaacgtctggaagtgaaggacgaagcgaaggcagcctaacggccagggccaggggtgtgtactatgacgcgccccttggttcctccctagagtacatggtaggtccgtgtattgtatggatgaactaaccgaggataaaaccgtgtggaccccttttggtagctttctggtagctgttacaaacgattacgtgcaaggacgttgtaactcccgttcgtataacagcgatgggtctgagcaggtagtgtaccgttgggctttcgtcgatggtaagttcgcctgcggtgtatatgtagatggccgtcccatgggcttctgtgggtggaccaaatgaagtccacctacgaagctgcccacgaacgtgccctcatggttaatcggctacagaagctaaccagaatgcttcgtgtccaccacgaccctaagtggaaacaggaacaacaggaacttatcaagaggttaaggcgatgattatctctatcgtggtgtcttgcgtaggcatcgggtacttcttcttccgtgactggaaggaggagatgggtatcaactgacccaactgatgaggccatggtgattcctggccgaaacccccaccggacctatggttgcaggatggggagtcttgggaaatcagcaaaggaaaccatcccgtgaaacgcaacgactatcgtaaggtcagccgcaacatgcaagccatcgaggctatcgaccgcaagattgccaaggtaactcgtgagttgaccaactccagcggcaatcaccttggtaaaaccctggagttgaacaaactccgtgccaagcgtgcatcgctggctaagaacagggcgcggtaatgtcatggaagtatattgcatgtgccgccatacgctcacgttccaatgggttgttgctggtagcgtgggtggttctcttcgtcctgtcctcgaccttggacagcatcccttttgcatcgtgaggtaatccgatgaagattaatgtggtagaaaagcccaagaaggttccggcgcataccctcaaggctacagatgttttccgtgttgagaacatccatgggatggtacttcgggatgaccacaaccactacctccccaatgacggcgatgtgtacttcgtttgcctggaggctggtatcatttgcagcatccatagcgactgcgaggtcatcccggtggacgctcaaatgaccgtgagggtctagtgtactatgacgcccgccctgtatctgctcctctggttggaatccttggtcagtatccgcaggttccagcctaaccacaaggcgtaccctggttggtacgtcacccatatccgtgtgtctatcttcggcaaacgtgtaggtatcgtctatgaaatccactaaaccgcaagtcttctggttggtaagcaaggatggtgagcgtcacgtaaaggtcatcaatttcggccagttcatcaccgaaaccctttacgaactcggcattccggtggaccacatcgttcatcgggttcagtaaggtgacgccatgaccaatacctctttcaccgtagcagtggcaaagccaaggtttgagttccacatcagcaagatggcggacggtgcctacgtccattcgggtgattccgggtctgtcgacttggtttacctcaagaaaggcgaactcgtgaccattattcacaaggatggtttcaacatcctcaagtgcaaggaaatcggtactcaccctgatctattcccggccaagtggttgtcggtgaatgcctgcatgtgggggccgtatgaagaataaacccatgataggccagataatggcccaggagcgccgcatgaagcgtcgggtagaaaagcgggggttcaacatgagcctccaggaaggcacccaggagccccgtggtgagcttggtttcaccttggctgccgtaggtatggagtcgagccgatcggcttaccttcggcacgccagggaggccatgatccaatctggtgagccttgccctcattgtatgccaatcttcggtcccaaagagggccgttgctgcaactgcgcgagggactggtgatgggccggtcgaaacacctcacgttcctcccgtcgaggatcactgtccttgacgatgatacggtctatgtgccttggcgataccagttggaatccctctacaacatggcttccgctggtggtgctactgaccccgaggcagtcaagggtgaattccttgattgggtacgagcggagtatgggcgatatgtgtccatcgagcttgaaggaatacccgaggacagggaagatgccttcgatgagtatgtattgaaggggtctcagcaagggtaagcaaaatgatgacatacctcctgataatcccagcgatcctgatctacatggccttctccttgctcgtggctggcatcgccgggctggcggcaaactgcgatgagtacgggaggatgagccagaaggaccaggacgtttcaatcatcctcggtatcctgtggccagtgtcactgccctggatgtgcttcatgtgtgttatctggaaccctttggctaccaccatccgtgcggccaaacgactaatcaaaggagattactaatgcgccgtatagacttcccttcctgctgcaccgccaagatttacattggcatgggcccctcgggtaccgctgaccaccgagccggggaagcgtccaatgggttcagcccccgtggtttcgccaaggaattgatcggggtcatccgtcgcgagtacaacgaaggtcatggcaccgccgtgttctccgtgaacaacgagcaggtggtagccgataccatcctccgcagaatgggcagccactacaacccctgggcctccagctacaaccactcgacgaaggttcgggttcacgtcatcaacgtgcaagctgcggcagaaatcctcatcaaccacggtgtcctcatccgacgactcggtggtttgcaggactaccccggtactgtcgagcactcggaatacctcgacaagctctgcaaaggtctgtaacatctaggccttgacattctgctgaaagtgtggtataataaccttaaggtgtccggggttgctttatatccctaggataccttaaggttctaaccttctatcttcttcatcttaagaaagaggtaagaacaatggtcctcaagctctacactcgggtaatgctcctggctatccccgcatggataagcatcctctgggtagtaccacagatgctgtccccggctgacaccatggtaaacgccattggtgctgccctcctggtaatctccatcctgtactccctctgggctgtcagtcacctgtactcctacgcaagtaagctctctggaaagaaggaggtgcatcgtggccacggtaacgagaagcagtaaggtcccaaccagccccctttacttcgaacgtaagtgtgattcccagatttaccttcgttcggaatcccggaaggacctcaccatcccgatggtaaacatctgcaatgggagtgtcctgtacctacaccctcgggaactccccgtgtatttcgtggcgatacccgagggtgaaactctcaaggtgaaggtgtgatgtactatgacggaacagcagcgagaccgcctccgtaaggcaatccacatggatctagaaggtatcggcgaagatacccccgacctctacgacaacatacataagatagaaggcctgcttggccacccaggtaagcccccgcatgattggggcttctatgtactgatgttcgtcatgttcatttccttgtgcatggtctacatcactccccttctctacaagtaaggaatccctatgaagaaaatcctcggcctcctggccattgctgccatcgctatcaccgcaggttgctccaaggttcccgctggctataccggtgtcgtcgtcaacatgatgggcgactctaagggcgtcgatctgaaggaaaccccggtcggctggaagttcctgacccccaacgaggagttgttcaagttccccaccttcaaccagaacttcgatctggcggtggttactgcccaggacaaggacggcctgaagttggacttccccatcggcgtcaccctccgggctgctcctggtagcgcacccctgctgttccagacctaccgcaagggtatgaacgagatcgtaagcgtgaacgtgccgcaggtggtccgtaacgccgtgaacaacgccagcagcaagaagtccgccgaggccatctatggtcctggcaaggaagcctttgtcaaggaagtcgaagctgccgtccgtgagcacttctccacccgtggcataatcgtcgaaagcctgtacctcaacggtatgatcggtctgccggcgcaggtggtcgaggcgatcaatgccaagatcaaggccactcagacggcgatgcagcgtgagaacgaactgcgtcagacccaggccgaggcagccaaggctatcgcggcagccgagggtgaaaagcaagcggctatcctggtggcacaaggtaaggccgaaagcctccgcatccagggtgaagccctccgccagaaccccggcgtggtagaactgaatgccatcgagaagtgggacggcaagctgcctacctacgtcaccggcggccaagccatgcccttcatcaacgttcgctaaggaggtggacaatgggtaagcgtaaggttttctatgagcgtatctgctccaacggtgaattgaccctgaacggcaacctcaaggccaccaaggtgtcggcacccaccaaaggcaagcagcagcgtcgcggccccttctaagagggcgttagtaatgcccctaggaactccctgggggtattgctggctaactcaatcaaggagaaaacaaatggcccgtatcaagtacgccttcggtatgaaatccaagaagggcggggttaaggccctcaaggtaatgacctctgcctcctgcttcggagccatggagggggtggtaacccatggttataagctcgacggttggaccttcgtctgctcccgtcgaagcaagaagttcatcgatgcacttaataagtgtacccaaggtgaactcaagaccatcaccatcggcggcaaggcctacaagatcccgaaggttcacttctggtcttacgaaagcaaggccaagacttccccgttcgtgaagtacgttagcgggtcggagttgatctctcccactcaacacgggaaggaaggggtttgcggtatctacttcaacccgaaggaacataccctagattcctggtatcccatcatgaagttcctcttcaagctggtatccagtggtctagaccctcaaggtcgagaggagaagattcacatggagcttgctgaaaagtatggcttctggaagtcctacctcgcaatgtctttccacggattggtagccaatggatacaccgggtaccccctcaccaattacatgttcagtaatgattgggaggatatcaagaaaggcgatatccacatccagtccgcagaagagtgcaaccgattcggccgttgggtgcccaaccgtaatgccccaggtggacgtgagtgggtaaggtccaagccctacaagtcagaatacctggggattaagctgaacaaggtggaggtggtaactatttacccccagccaaccatcttcggcaagaaaaccccctacgacatcgtggatacggaactgggaggattcctccggcttactccttctgactgtgaaaaacacggagtggtcatgctggggaccatgggtgaaattcactggggtcgcggctcaagggatatccccctggccctggaaggattcatagagaaaaacttctgacaaccaaggagaaatcaaatgggaatgtatgcagcccataacgtgtactacgatgccgagggtgctgaggttggtcactgctgcgttaaatacgtggctgaatacaccaactgcttcggtgcattctgcgactcaacggggccccacccggatatagtgtgggagaccggggttggacacctcctggtgtctacccacgagaacactgctggtaaactggtagaattcttgaatagtgatctggtcaacaggatcaccgacggtggaatcctctcggcttcccaggactggcccaccgagtggtggacgggatctggccgtaaacaaaacctctccaatcctgaccacttcagcccacctggccgccgacaggctgtgtacgttcgggtggacctcaagaagaacgcatcggcaatcatctgcgcactccgtatgggtgatcgtctctggggtatcggggatcagatgcgtcgtattccgaaggaagctcaggataaaatcctgggattcaacgcagaacttcttaccctcgcggcttgtgcccaggtcggtagcactgcccactgcgacagctatccggcgatgttccctgtgactgctggggagtataaggagcagtgtgaagccaatggggatgatgtagaggatagctacatcagcgaaatcatggaccacttgacgggtgggttgaaggatatcacctacttcgatatcaagagcatccatggacgaactcgcgaagagttcaaggacaagctcaagcaccacaatgacccactctggctgggttataccaaggatgattacctgatcgagtgtgatgggttggatggggtacacgatgatcgaatcctttccatcatggcgcccatcaccatcgacgtaggggaccccggacgggataattcccccacggtacccaccggttattacgaccttcccgaaatcctcgaaaaactggagagcatgcaatgaacaacgcaatccccctgatcggtgcagatcccgaagttttcgtcggctacgaccgtaacccccagagcgtcatcggcttcatcggtggaaccaaggaagcgcccttggctgtagccggtggtgccgtccaagaagataacgttcttctggagtacaacatcgacccggccagcaccaaggaagatttcgtcaagcggatcatttccgtccgactccttggtgcccagatgctccaccccttcggcatgaacatcatcgagaacctgtcgtctcacctgtacgacgaggaactcctccgcagcttcggcccccaggcttatgtcttcggttgcgagccggactacaactgctggacccgtcgccagaacgtgatgccgaacgatgcacctccgaccctgcgcactgctggcggccacgtccatatcggcttcggccacatcgagcgagtcaccaaggctaccacccgcgaggtcatgcagatgtgtgactacctcctgggcctggcctctgtccttctcgacggcgacacccagcgtaagaagctgtacggtaaggccggtgcgatgcgctacaagccctacggcggcgagtaccgtagcctgtccaacttctggatcttctccgtcaacctgaccgagtgggtctatgaaatggcggtacaagcctacacctcgaagcacctgctggaagagtacaagtccatcgtgtctggcgatgaagtccagcggatcatcaacgagaacgacggtgttgcggcggtcgctgctcttcaggccttgggggtgaagtatgaatgacctcaacaacaggcatcgtctggccggcgacttcaacatgtactacagttccaccttcgccttcttccgggtggacggggagcctcgggtagtctacgtggatgacactgaatccatcggggatgaccgccagttcgatggcttccgtctcctgggtaatatcttccgtcccgacggcggacaatactacggcggcgtagtgtacagcgaggtcgaaggtgtgcggcccccgagtgggtactatgacgtcttcggtggcggcgagcgagatacctacgtgtcgttcctcgtgaacaatcgtacccagcgcaagggtgttgacccccggaatgtcctcatcaaccacggccagcaggcagtaaccggtcagatgatgatccgtatcttcctccaagcggaagagatgatctccgacccggcacaccgtgacttcttcatcaaggacggggtagtcaactggaaaggtgtaaaggtagggcagatggtagacaaccggctgtccgtagatgaacaattcaagaaccaggaggacttgctatgtcggttattggcacgcagataggtttccgtaagaaccagatcaagaccccggagcaccacgaggaacttcctgcggttgcatccttcgggttcgaggttgaactggagggtctggaccagtggcccgaggttgatggctgggatatcaagaacgatggatctctccggaatggtatggagtacgtcttctctggtccggcttctggtgaacaggcgatcaatcgtgtggaagccttcgcgaatgccatggaacagaatcccccggcacccaccttccgctgctctacccacctgcacatggatatgcgggatgtgaactggaaggtttacgagcggactgtcctggcctacatggtattcgaggatgtattcttcgatcactgccaaccgtaccgccgggatagcaacttctgtatccccttcttcagcaacgactggttgtcccagaccttcggtcgccgcatcctggcacccgagggtgatcgagagaaggtcttgggccttacctcctggccgaaatactcggccttgaacctccaggtcacccacaacttcggctccatcgagttccgtggtgcccacgcgatgaccactcgctcggaaatggtcgggctgatgcagcggatgatgtgcctcaaggcgttcgcgattgcccacgaggaaacccccttgggtgagttcgttaaggtcctgtcggatgtgaaccttcgtgatatctttttcctcggcgtagcccctgactatgaaatgtctccgggtggccgggaaatgggtatcgcaagcgcatccctggccattgcaactatgggctttgttcgctccggggtagaccccctggaggatgaacagaaccgtcagcgtcgtctccgtgagcaggctcgtgaacaacagcgggcactggatcgtcggttgatggctgcccgaagcgtcctgggtagaatccgagagggtgcccctgagcgttacaacctggcgatcatcgaagggagtaacatgcggatggatcaggtgcttaccactgtccagtccctgaggatgatcgggcaccaagtaagcgtccgagacctcgtagaggataacgagattcttcgtgattccttcgtacttctgctggacaacccggaccatatgcagcgtcaagctggattccgactcgaagaaaacatgtactaaggagataaacaatgtgtggattggtaggcttctgtgccacaactaacgcgagtgataacgaaatcgctcttctcaaatccctcctggccgtggatattatccgtggtgcccacgccactggtctggccaagatcgacccggttaagaacgaggtaggaattcacaagcgggcagtagatgcctacgacttcctggctgatcctgaaaccaaggagttcctggacaagggtcgggctcgcatctacatgggacataaccgttacgccaccatgggtgacaagacggaccatgcgaatgcccaccccttccaggtcgaccacatcaccatggtacataacgggactgtggattcctggggtctccatctgctggacggcaatgacaagtacaacgtggactccaacatgctgtgcgctaccattgccaaccacggagccaagaagaccttcgaagagaagttctccggtgctgctgcggtaatctggtgggactccaaggaacgtaccctgaacttcatccgcaacgatgagcgtccgttgttcatggcggtgaccaccactggtaccatcgtgtgggcatccgagcctggtatgctcaaggttttcctggagcgtcccaacgctaagatccgccttcgttctcccatcgctgaactgaaggctgaagtcctggtaactatcccgttcacggaggccggagtgcgaaagggtgtagaaccccagaccactccggttacatttctcgaccttcccatccccgaaagcgaaaggcaagcagcggcatggtggagtcgctacgtcggtgtctccgactacgaggactatagccgaagccaaggcagccaagcgggaacgaaaggcagcaaagcgggctcgtcgtatggaacgtctggcgatgcgtacgcaaggaacaccctccggatcaacaacaacctcgatgcagcaggcagcaccttcaagcaccgccaactcgtcaccttcgatgttgtcaaagtcgaggcctacgcaaacggcagcgaatacggaactgtcactggaatcgagcgtgaagaaaaccttctcatcgaagctcatggcatcaatgtcgccaaagtccacggctacaccgtcctccgaggaagtatctccaacgcctacttcatcggccaagaccgtgatctcaaggttactgtcgaggatctggcggtaagctgcctggacccaaagcatcggccgactcctggggagactaccccggttttgaggattggaacgatctcatcggagacgaaatcccattctaaacccagggttcaagtcggcggcaccttggggaatacccctccggccaacatcagctaccccttgaaggttcagggacacacgttcaacaacgttcatgtctttcgggacttcgtatcccaggggtgtgcatcctgcggtaagatccctaccgcgtatgaccagcgtaatcgtcatctgacggtgtacgagggtgccaagttcacaggtagcctggatgagtgtgagttcatctgcggcgaatgcgtaatcgaaaataaataggaggtcaaaatgacccaagtaactctcaagcgtcaagtagtgatccagatggaaaccgacgcaactcgtaagtatcctttctcccgcgacaccctggacaagatccagtcgatccgtcgagtcaaggagcaggaactcaatgatgccaacccggacgaggaattcctggtaccggccccggtagtcattgccgaggccatcgatcgactcttcgaagattacttcgagtaaagtagtgcgttagtaatagcccctggccgacccatgccggttcctaagctgcgtacatggggttcaacttaggatcacaggggctattgctggcttcactactaccctcaacagaaacaggagatatgccatgttctacatctacaaaggttcccgagcgtcttccggtgccgtaaatcttcgcaatgccctgggtgcccgaatccttcggtccgaggggtctacctaccgtggccgtgcgggtactgcggtaatcaactggggtaccgtaggtgcagaggcacgacgcctccagggtatcgccccggtattcctaaatgatccggccatggttgctcgctgcaccaacaagctggacttcttccgccacttcgaggccaatgcccctcacttgattccccgttggaccgagcgctgggaagatgccttgggtgtactaaatatctctggtcgcatgtatgcacgtaccgatctgaacggccatagcggtcgtggtatccatctggtgtgtactgtcaatgatgcagaagttgctgcaatcgatgccctccgtagacagggacactacccggtacacatctacggtcacacccacatcccggatgttatcaccagggcacaactgttcacccagggaatcgtcggtaagcgtaccgagtttcgagcccatgtgatccgtggggaggtagccctgctccaggtcaagctccgccgtactgccaacgatacggtgaccaacgaaggccaaagcatcgtccgtaacgtagccggtggctgggtctatggcgtcaacgatgcaatgggacgggatggcgctgagcaggctatgtcggcagcagcagaagctatccaagttgcaggcctggacttcggagctgtggatattatctaccagcacgctactagccgggcgtttgtcctggaaatcaacaccgcgccgggcctggatgcagaaggcagcgccctggaggcctacgtcaagggcttcaacaaaatcttcgaggagactatctaatggctgttcgtgttttcgtttatggtactctcctgtctggtttgtacaaccactaccttctggaaggggccgagtttgtcggcaatgctgtatcctgcgagcggggtctgatgtactccgctggcggattccccatcctctcctttgcctcccgcgctgacctcatcgtaggtgaaatctggcaactccccgagggcgaagcgggggatgaaatgctggagaacctggatgccctggagggttatccgggttggtatgatcgtaccctcaaggatttccgaatcaatggggaacgaatcaaagccctggtgtaccatcaggatagccatatggcgatggatatcgtcaaggatggcgactggaaggcacacctggcaaaacgacaaggagcagtataatgaacgaaatgaccgtagacaaagcagtagaagtctaccgcgataccccgaacaccttcggacaccaagagctacatgcccagaagatgctcctcaaggaaatcctgggacttgtagcttcccagcgacacctccaagactctatcgaggtctccaagattccggaggcctcggatagtcccgagaccagctacggtgggtactgtgacgaatccattggaattcgcttcatgtgggagcgactgaagaaaatcgaggatcgtcttcgggaactggaggaggtctacggtaccttcgtaacaactccctataaaaccctaccgggcaacgtgaatgctgtaccaagcctggttctcaagagtcaactggaggggtaagtgaagaaaatcatcggtgatacggcttgtccgggttgccgagctaaaggtggggataaaacaggaaatcacctcatcttgttcgttgatacagaaaagggtactcggttcggaagttgtaaccgttgtggtcactacgaagtcctcgaagagggtttcaaggttcctgaacgaagggagaaatccgaggaggatatcatccatgaagtcaacgaagtccttgagtatccaattaaagccctcgatactcgaaagatcagcaaatcaatcgctgaacggtacggggtacgtgttggtctatcacaagaaaatggtgaggacgttatcgagcattactatccacgcacccgcgatggggagtaccgagcgtttaacgtccgaatcctagaacctaaggctttctactatcgtggtagccccaagggtggtgttgaccccttcggttataacacccttcggcataaggatatgggccacctgcggttagtcatctgcgaagatgaactgtcggctatgtctgtggcccagatcatggagtcgaaactcccggagaagtggaagcatcttcgtcaggcatccattagttggtcctcgggtgttggttctgctgggcgggatatcgcattccttaaggagtctggtgtccttgagcggttcaacgaggtcatctattgccacgatgctgatgacgaggggcgtaagtcagtagaaaaggtacgtgccctgtaccctgagtgtaagtttgtcgagctcccgctgaaggatgctaacgacatgctcatgcgtaatcggggggatgaggtataccagatgatccgattcggcagcaaggtgaagtctcctgactgctccgtgactgtcgatgaggtatatgctgaggctctggaaccccctaagtggggcaagagttatccgtgggagggcctaaccaaccttacctatggtcagcgtgatggtgaaatcatcggggtaggtggaggtactggtatcggtaagaccctgttggcccacgagattgctgcctggaattgcattgagcacggggagaacgtagggactttcctgttggaagagcaggtagccatgacacttaagaatatcgcggggaaggttgccaacgtgcccttccaccgaccggatatcgagtgggatgagcaagcctttaaagatgctgcgggtaaactccggggcaagctcttcatgtggaagaataagggtcagaacgattgggatcatatcaaggagtgtattcgcttctgggcagtagccatggatgtgaagactatcctactggataacatgaccgccatgaccaaccaccttagtccttccgaaatgaacacggagatcgctcgtatctgtacagagctcgcagggatggccgacgagctaggactgcggatcttcatcttctcccaccttaacccacccaagggtaaccgtacccacgaggagggtgctgaagtaaaggaaagccagttcactggttcccgagctatgcagcggtggtgtcagcttatgatcggattcgagcggaacaagcaggctgacggtgaagagaagcacgagagtcgaatccgtgtaatcaaggacaggaactacggtaacactggcctagtgttcaccaagtataaccctgagacgggtcgcttggttgagcgcgagggcagttacgacgaggtacctgctgacgatgacaccccaatttgattacgtgatctatgaccttgagggggacggactcttcaatgaggtcacaaggctatggtgcgctgttgcagtagacattccgactggggtagtccggggattccggcccgaggaaatggacgtgttctaccgcatcatcgcccatgcaaagttcgtggtcgggcataacatcctagactacgacaaccgggtccttgagaaacttcatgggatcatcatccctccggatcgaagctacgacaccttggttgcatcgaggttgacttggccagaccgaccccagggtcattccctgggtgcctggggtagattcctgaagtgtcacaagggtgatttcaacgacttctccaagttctccgaagaaatgtttgagtattgccttcaggatggagtggtcagtcacgcactgttcaactacctcctccgggtactcggcatgacttggcaagagcttgttgaatggaggactgtagattggctaaaaagcgagtgaggaactacaagcgtgaaagggagctggctattcgacgcggcgaaacgggcgttggctctaagtctggagatgctcagcggcaccgagcccgccgaaaggtggaaaagcgtcttggaaggaaactcggagccgacgaggttgtcgatcatatcaaacgtgttaaagatggtggcggtaacggggattctaatctccgcgtccgtagtcattcttctaacgctgctgatggtggtcgtgtgggcaatcgtaaggccaaaggcattcgtaagaaaaagtaactaaggaggggccttcgggcccccgaggactctctatgttcaatcgaaagcttagcatcagtaacatcctcaattccttcgataaggttctggtgaacctgaagaccttcatccaagagtcttcggaggaatctgagcgcatctacaacgagatcagcctgctcaaagctgagcgtacccaggtcatgcaggacaacctgaaggcccagaaggtactggctaacctggaagaattgctgggaggtaagagtgaagaagtatcgagttaacgttgggttccaggacaccaaggtgttcaacgcagacttctaccgcatcgagttggatatcatccggttcttcgcgggtgattccgatgccaaccccatgaccgtccgagccaatgagatcggtgctgtccgtggatgggtttctgtggaggagattaacgatggcgagtaagaaggaaagcctggaggatcaggcacggaaggagattgccctggagaaggagttctctggtagctggggtggccccgagatcgatgctgatgacttccccttgggtagtgcctgtggcctagatcccgaggtatgcgagtcatgccaatagctctacaagtccttgtcatcttctggagtgcattcttccaggtattcctcctgggattgaactctaagctccttcgggatgacaagatcaaggctgggtttgtagtgtcttggtgtatcacgctggctcagtttgcttacatcaaggccgtggggtcttcccacttggatatcggatggtttatcttcgtatccgggtggggaggtgcccttgggattacctctgcccaatacttctacaagtggtacgacagagtattccacaagaaggcttgacaaatccagaaaagtgtggtataataaccttaaggtgtccggggttgctttacccctataggagatacaaatgagtgaccatgtaagctattccaaacatgtccgtggtaagtacctgtgtaatatggcctctgccctccataagagcatggaggtacaaaggactaacatccgtaagttcctcagcagtccccacattaccctacgggagaagcgtcgggtgttcctgagcctgccagagggattcctgggggtgagctatttcacggggtctcacctgaacctgagttcctactcggatcgtcgaaacacccggattcgtgacaaggatatgagtctctatgatgacttctatgtggacaggggcacccaactagatcctcgggatgctttgtttgccaataaagaggcgaaggagtacgagtttcagtttctgaggaagaagtgggggactgacttcgagttgtctggtgaggatcttgagaacgtcaagggttgccagcgcatgatcgatctgtcctggtatctggtagacctggcctgtgaacgtgggtgttcctacttcgttttcgactggtgattacatgagcaagatcaagagtatcctcatggagcgggtagatgacttcctgctcaagcaagttgctgtggccttcctggagcagcaatggaagctggaccgcagtggtaccgtggactacctctcctacctggggggtgtatctcacgaagctgtggagacagttgtagagaatctagcggagcgtcttaagggggattaagtggattggagaaagtcactgttcgttgagcacaaggtagctgatatcatcagccgccagagtaaacgtggagtctacttccagactcagcgggccaagtggctgatccatgtgcttagcgaacgaatcctcaagattgaccttgaggctgtcccccagatgcccatgatgatcgtaagggctggggccttcagcaagccattcctaaagagtggtaagccgaaccaaaggctccagtccctgtggcaacgtcttgggcatttcgaggtatctggacccttctctgcaatcgagtatgtacccttcgaccttggtaagactgccaagttcaaggactggatgctggatcaggggtggatacctgaccaatggaacatcaaggatattactgtcggcactgatggcaagaagctacgtggatctgaccttaatgaatccttgaataagtacattgaggatctccgacagagcaagtctggacgactccgaatgaagctccaggggatcatccctgggaaaactaccattggggaagtcaagagaaagctcgaaaagcaacgtaaggtcctaacgactccgaagatgactgaagagtcgatggataccgtccagggagacctgggcaagctggtgatgcagcgaatggtttgggcccaccgtcggtccctcttgcaggggctggtagatcaggtgaggcctgatggacgcctagaggggagtgctaacccctgtgcaacacctacgggccgtatgaggcaccgtgtagtagtcaatatccccgctgctcgttctcctttcggacctgaaatccgtgggttgttccaggggacacctgaggctggtgaatggaaatggactgtcctccgccgtgatcttggggagaacgaaagggttaggcccttcactaacatcgtggaggaactcaagaagggtaagtggaagactgtaggaaagtaccgggtatacgtcccagcgaaccaattagtattcgtgggctacgatggtgctggtctagagcttcggatgcttgcatcctacatcaacaacccagagtacaccaaagaggtggtcgagggtgatgtacacacggccaaccagatagccgcagggcttcccacacgggacgatgctaagacgttcatctacgccttcatctacggtgctggggatgccaagattgggactatcattggtggtacaagggcggacggggctaagctccgggcccaattccttgaagctaacccagaccttgctgcactgattgagagggttaagcaggaagccgagaggggttatctcgaagggctagacggacggaagctaaccatgcgacgttctgagtctggcgacgtgatgatccacaaggcattgaacaccctcctacaagcagcaggtgcaattgtcatgaagtgggccatggtgctcctagacgagcgagtccgtaggttaaacctgagggcttggaaagtcttggatatccacgacgaaggtcagtgggaatgccacccagaggatctcaaggcgctacgtgagcagatggaagtctgtgtccgggatgctggggagatcctaggtgttaactgtcctttggctagcgattctatcgctggtcgctcatggaaagacacacattgatacatctgggggttgactttcagcccccttttgtggtataataccttcttccctacgagaggtttaagatatgtctaagaaagtttcccaacgattcaccttcccggtagcgaagctgatcttcccctacatcgtaactccggataccgagtacggtgaggtctaccaagtaaccatctgcattccgaccaaggaagaggccgacaagctggtacagcagatggaatctaaggatgttcgtctgaaggacaccatcaaataccaagagcgagacggcgagtacctgttcaaggttaagcagaagaagcacgtggactggatgcaggatggcgaacgtaagtctgccgtgatgaagcctgtagtcctgacctcggataacaagccgtatgacggccccaacccgtggggcggttcgactggcgaggtaggtatcctgatcgaaacccagaagggtccgcgaggcaagggtactatgacggccttgcgactgcgcggtgtacgtctccacgagattgtatccggtggtgatggcgaggatgatcctctgttcggtggtggttttgctgaagaagaggacaagtccgaggacgtattcgacgaggtattcgatgacgaagacgctcctatctaagggtctagcggatcatgagtcgggggtatgccggtcaggctgcccctactgcttaattgaattcgagaaagtgtggggtgtacgggtggtgagttctacagctgcatctaataataaagtagaggtcgatcctaatggaatcaaacctggtgagccgggcgctaagctcgatagcggcaaggtggatgttggaatcatcttcgaagcgttcccgagggctctatatgcagtggcacaagttgctaacttcggagccagcaaatatagtcgcgggggttggaggcatgtcgagaacggtatccagcgatatgacgctgccttcggaagacacctccttgagcgtcacaagggaaaaactttggacccccaaagtaaactaccccaccggtatcacgaagtgtggaacgccctagcgtccctggaactcgtcattcagcaagaggaggaatccaatggaacttctgttggacccaagggctaagactgttcctagcaactactctgtgatgggaatcgatgtagacctggggcttcccccaggctacagcctaacggaggaagctatggacaaagccaagcgtcaagagagcgagtattacgactggaaggggtatgaagcactggccaatccagtgatagagcacccagagtaccgagccaagggtgaagcctttgccctccgtgtcttctgggaagagaagctcaaagaatcccaggtcgtagaagaggtatcgtgatgattgaggagcggttctggtccaaggttgataaaaccgagggttgctggaactggacactaggtttcccatacaatgctgttcagaacatcagatatggcagggcgtgggctcaatgctgggagtagtccagcgtaaggagggtaagtagtatgatcgcaggaattgatggcgacgtactttagcttcgctacgaattgggacatgtggctatgtcgaaggaacacatcttcgatatccaggtggagaagccatggcctgaggaagaggtccataagctcgtcgatgataaagtcgaacaaattatcaaaagggtaaatgcagatgagtgtgaaatctaccttactggccaaggaaattttaggctggagcttgcgaaaatcaagcaatataagggtactcgaatcggtcttgaaaagcctcatcactgggaaaccgtgtcggcccgacttaaggacaagtggggagcaatcactttccacggtatcgaggctgatgactggctcggaattcgagggactgaagagggagataactttacagcgtgttctagagacaaggatatccgccaagtcccaggatgctaccattacagttggccctgtggagattcccagccggagttgggaccatttcaagttgatggtcttggaacagtctccgcttcttggcgaatgtatggtgttaagaaaccgcagaagtcatggaagcttgagggcaacggtacggcattcctctacgggcaactccttgttggtgactccgtggataacataccaggcctcccagggacgggaccaaagacagcggcagatttgcttggggagctttctaatgagagggatctcttcgcagcttgcgcttacgcctaccaacagaagtacggagataattggaaggagtaccttgtggaaaactttcgtctcctctacctcattcgcgaccgctcttggcttgatattcagcagtccggtaacgagtatcactgctcactgaagaaacattgggagatcccctatgacgacgaagatttattctattgatgaggccctatctatctgtgagggtctcttcaaaatcctggagactactggcttcactgactacaaggtggctggtggtttcctccgggatgcagacaacggggtagcacccaaggatattgacctatatgtacgcaggcctcgtgtagaagccattggtagacgagtctcacgtgtctttgggccccagatggttccttgcagtgatgatgagcttgaggtagaagtcatccggttctacaacaaacttggtcacaagaaggttcgtacggggtccggggaattacgcaatgggtatcccgaggggttttctgtgtgggagtccattggtgttgatctcccggttaacctggtcgtatccactgacagtcacccagcagagttcgacatggggatctgtgaaatctcctgttggcctattggcacccttcgtcgtaaccgtagtggagaaatctaccggtccagggcatacgagtgggacaaggagaataagtgcatcacaatcaatcgtatggttgatccgttgctggagagtggcaatgagataaccgttggccagatcgagagactcgttaatcacgtatcgagggtaaaggctaagtacccagaccaccgagtgtgcattggggattggatttggatgcttcttcgttcacgttcagtctacgcagggagcgcaatggattttatagtaaggcttcaagaggagggtctaattggcaaagcaggggagattcttcagaaccaaactgaagtcattgattgggacgaagtacgacagcgaaaccgagaagatcgtccacgagacgatgccttggatgcagttcaagccgtccccggtaccatacgtcatcgagcacaagtacaagccggacttcaaggtatcgacattacaaccttgtggatcgacgaagaatctgttggtcgaggtcaaggggtacttccaagaggcgtctgaggcatccaagtatatctgggtgagggaggcccttcccccggatactgaacttgtgttcatctttgagcggcctaatacggcctgccattggcttagtaagcgtaaggatggcacaaagcaatccatggcggaatgggccgaacgtaacggcttccgctggtttactctagagactttcaaggagtccttccctaatgagtaagaagtacaatgaagacactctcgttatcgcggacactcaagttcgatccgaggttaacatcgaccacattggtaacctcggggagtggatcgcacgtaaccgccccaagcgaattgttcatattggggaccattgggacatgcccagcctgtctagctacgaccgtggtaccgctaagatcgaaggccgacgagtcctcgctgatatccaagctggtaatgatgcgatgcgagtcctgctcgatcctcttcgtcgcctacagcagcatcaggcgagttgtaagaaaagggtctaccgaccagaaatgcacttcttcatcggtaaccacgaggagcgtatcaagcggtatgaaaactctaaccctgctctccaaggttttattgggtacgatcattttgatctgtccgattggattgtccatgatttcctcgacgtgggtgttatcgaaggtgtcgccttcgcccactacttctacaatcccaacagtggtcggccatacggcgggagtgccgagcatcgcctcaataagatcaagcgcagcttcgtccaaggccatgagcagggattcaagtaccacatcgaggcagtaggaaagaagcgaatccacggattggtagtcggtagcttctatacccacgatgaatcctacaagggtcctcagggtaacgaccattggcgaggtgtagcccttctccggaaccacaaggacggggaatatgacctcaagctgatgagcgtggaggagttcctgtgagtaagttcttgccagacctgtactacattaagtctgagcatgacttcggtcaacgggggttggcgtttaagacgccgatctccgcagaactctggctggacatgaagtttgggaaagggggtgcagaggaggggcttaagcgagggatgtattccatcgaagtcctggagatcctctacatcccaagcgttcaccttccagatatcttggggtaatctatgaaagaccgagtgggacgtaagctagaggtaggggacagtgtagtcttcctggtccacaggaacacctcctcccatctagctattggtacagttgatgggtttactccgaagatgattcggatcaaatgtcctaccatgagttggactattgattctgaatatgtcctcaggagcagtgacaaggtggtgtactatgacaaaggctgaactggagaaagcacttgaagagacgcaaagcgctcttgcgaaggctgaggcgaaggccttttcctttgaagaactggctgaagaagctaaaagacagattgaattcctcgaagggatgctagacctagtagacctcagggcttctgtattctacggagattggaggggttatgcagaaagatcaaaagggtaagggtggattcccttggacctacattgcggtagcagccttgtttgccctgctggtttatgtagggtatagctgactgatgttactcctgaccctgggagaaatatctaggttactaatcgaagtgttatcttgggcaggttccttatgaagtatcgagtgcagcagctagggaagcgtctcttctacatacaaaagaggtttctctttatgtggaggactgttacggactcgggaggttgttttatggccttctactccttggaagatgctgaggagttcatccgggataacctaaagtatagggattctccagtctaccaccccgtcgagtaaccaaaaaaaaggccccaagggtatcatcccaaggggccttatctttagctccggagagcgttcagcagagtgttgaacttatccacgagggcctcgtgagtgtccgtataggaagccacggggatctcagatatcttatcctggatggaagccgcaatggcttcatataggccactcacttcgctagccttaggcttccagttacctggtttagcctcactagccttagcacccacctccagaagcttaggcttcccctcaatatcctcccacttcactggctcaaagtctttcgggccaatgacttgtcggagggtcccatcctcattacgaacagcaatagccttcgattgaataacgaatacactgttgccgtcgttgtcagcgatataacctgccataattaactcctaattaagctgctgatttgaaggtacccacggtaccaccgaagggatatacacggatagtgcattccccgaattgaccatcagtctccgtctggttacccttagcataccaagccttgtccggagatacagcaaacttgatcttagctgccgatccctggataaagtggaagtgacaacctggggttacatcggggcccagggtgacggtaatctccgtagtcccctgagacatgaagaaccatccagactgttgcttagtcagggtaatattctgagtaagctgctgggtattgacgacgttaccacccaggtgagtagtcacaaggcggggatcaaggtagttctgttggagagaaccaatgttctgcacaggaccacgcatgtcgtcaaactgctcgataatgtagtcaccaatggtaccaccattttggtcatctggaccaatcacgtgcttgatagccacataaacatccaggtgttcccgacgggggtctactcggaattcactaccgaaagcagtaccacaaggggcctcaatcatagtctcagagaacaggccaatcacgtggccagggtcacggttaccacccgaggtttcaccaggagcacccacaagggtgttgaccaggacagaggggataacggcctctgaggggttctccgggaaggaggctgtaacgttctctactaccagggctgcgttctccttaactgcataatagtcagggaggaactctgtagcggtaacgatgttagtatttacccgaccggcatccgaggtaatctcaatgagatcaccatcggcattacgtcggaagacttttggcacatcaaccacgtaggcacggccaccaggaccagcggcatcagtttctacataagttgccatattacttctccttaaagatccagagcatcttccatcgcttccataccggcaacgaaaggacgtgctggagtttgcttatacaagaacttccagatttcacctgcggaagggtcatccccgaacgaggcaatagttttaccaacagccatagcaccctcagttgcagcaccagctactggacccaatagtacctctgcgggggtagtccctcggcggtaacccgtaagcatgtcgtagatcatagaggcctggagtggcatctgttgcatcactacgtccatcatccgttgttctggactacgggtatcctctcggctagacccaccgaacttagccagttgacgaagctcatcctggagatacccaagactcatcatcagaccaagagtgaaggctacacctgcggcacccataccagcgttggtccaagaaccagcgaagtgtgggctcattcgtctacggaacatcggtaggatgatgttaccataggctgctggataacccttcaagagggagaacatctgaacgtttccattgctcatccacataggcttatcagcgaaggttgggtcgaggactacctgatccacaaatcgacgcatagccagagtcttgacgttgttagccatcaagacttcagatggtgtagctggggagaccaacttgagggcatcctgctggataccgatgttaacccccatttcccgaagctgagcaaccttcagagcaccattagcagaactgaaggggaggcctgcggctagatccatcaggttattctgatagacccgcttggcagtctctgttgcaaacacccggttaacatgggttagaatggacaagccgttgatgaggaactgaccacggattgccttttggacagtcgtgttaaatacctcagcaccaacccgatcggccatcaaagaggtagcagaggacagggtgtggttcatatcactcataaacctaccggtctcagattttggaaccccactgtagatcctacgggctgcctgtcttactacctcccccatagttggcaatacagccccaagggtaggcatcacccctgccttagcgaatggtaggctgaactcagttagggtagagaaccctgcgaggggtagtcgggagagcacgagggcacctgacgtaacagccgccagcttcttaaggttggggtctttgatacgaccgtgcataccattgtaggcatccactaggtcatacatccgatccacttcttccttagtgactctcttaccagcccgttgagcctcagctacagcagaagcaatcttagcgttagccttctccccattgataccaaacctctcggtaaaggcaatccggtgggaagccccctcgaagtaatctcgaatttcctggagacgcttcttaggagtatcgttgagagaatacttgttgaggatctcttgaggcacggagccaaaggcccgactctcttccagctgaccatacttaggtactgcatcactctgggcaaaccgtccacgtagagtatctggatcaccttggatacgatatcgagggtctacttcccaagccccggtctgctggttctgagtaaccagtcggttaacctcaggggcagtgttaccacgagtatcatccgagacttccgccagccagttggctacagcatcctcagcagcttgacggttctggaagtacggagtgatgtcgttcaggaactcgggggtctgaaccttctctggggatagaccgaatggcatatagttggggatagtaccaacggacattccaccacggttaacagcctcattccgtacgtcatccatcaaagcacggagacgggtagcttctggggtattgacacctgcggatgtatctgagataatcctgtcgatctctttcgaagacttaccctcgaagatgttatcgagttcagagttccacttacctgcctggagttcctgatcctcaaagatagtcttaccagaggctcgcttaccactcatgtctgccctgaaagtctcagagaactcgcgggcgataggggaggccttagcaagtggctctagaagggacgtagcttcgtttcctagggcatcccaggctttcttgaccgtacccctaggctcaaactcagaagccttaggaggggcctcaggggcgttaggatcaaccacagcagatccagcggagtcctgatgacgacccagggtgtccaaaccggaggatacagcaccaccagcagtaccaatagcggtaccagtgaaggcagccgtcaggaggttatccatgaactgctctggggtttgtacctgccctactgcatcataagcaatagtatcctggagagcctgttgagcaccagaggttacaccttcagccacaccagagactgctgcatgcttaccagcctgggtaacagcctcgatagcggtttgcttagggagtccagactgaaccagcatctggtatgccccgtccttaccgatgtgcttcaagagagggccagcgatgaccccagcaccagcggtatccagggcagacagtccagcacccccgataactgcggtccagggattgctttggtctgggtctagctccttcatctggttgctcagggcacccacgttgatacccatggagcttaggaaggaaccaatgagcgctccacccatacgacctggggccccaaatacagagccagccttagcccctgctgcaccaccagcaagtacaggggccatcgaagggagagcctctacaatgttattcttgaggaacgaaccgatggatgggatatcttggatatcagcgaaagaccgaacatcaggggttccgtactgtgacgcttcctgagcattctcctcggccatctgtgtgccgtagtctttcaggtagtcactgccagtcagttcaccaagggtagcaatggtaccaccgatgttagactgcatggtatcaaccccgcgaccaatcgcagagctaatagaattagggtcagccggagttactagggcactcaggtctggggcaggctcaggggtagcaggggctacttcctggggtgcctcttcgataacctctggctcattcaaggaagccaattcagcggctacgtcgaggcccttgacctcagccagttccgcatcaatagcggccttcagttctggagaaagagccataagtcaccttctagttgctggaaagagaataggctcttaagatgtatcttaggatactaaccttcttagtaagtaagtcaaaaggaagaaggaatcttaagagcctataggtctattatactacattttggatactttgtcaagtaccttttatcgggttggagcaggatagtccagatcaccaccaaagaaccagttacccgtaggttgaagcttagcagcctcccgctggataataccaatagggttagccccagggttagccctcatttcgttacgaagggtctgagctatagcctgttgggcagtcttaccaagcttcttaccacccagggcctgagatccactgacttcactgaggatgcccaaggcatctttggtagtaaccggctcacctcgggctgccttagctgctgcctgacgtgcctgagcgctaatcttagcagtcttcagacgtacagcagaactaagctgggcattctcttgagacatatcctggccacgacgggttgtttcagcctgtagctgagcccgttggttagccatatcctgtccacgctgggttagggcaaggttggctcgcccccgagcagcctcctcagcccaccgatccagaagaccagtgttcttacgagaggtttcctcaagggtgcccttcttgacctccaggttcccttccccaagacgtacatcagcagcatccttagctaccttacgttccagatccttttccttgatctgacgatcagcagctgcggcagccatcttctgctggttgatcccagcctgtaggttacgatccagttgacgctcataggaagcagcgaacatatccccggctttaccagtcttgtctatggccgaagccagaagaccagtaccaatgagagcataagatacataacgagacaggtcatcattatccatagtcctcatctgggtcaactcttcgttcacccgattcttaagctcttggggtttaagctctacaccctctctctgggcatcagcctcaactacagcctgggccatttcaggacgacttacagcaccagtacgaagaccctcagctgcaccctgttggataacctgacgattagcctcctcctcatctgctacagcagcaccagcctcggaagccacctctggggtgatctcaggctcgatagagggttggttaggggttaccccataggacaggagttcagccccagtagggcctcctgtggcgttctgggctgcacgttggcctacaccctgggcccattggtttgcctcttgagcaacctcaggccccatattctccacagcctgactagcctgagccatttcttcagcacgagtccgttctgcatccccgagttctcctggggttacagcagcttgtatacctacagatacaggaccaccgaggatacctgcgatacgacccagggcaccacgacccgttgcttcagccgcaggggctacctcttgagcagcccgagaccaacggtcagggttctcaagggcagcctgagcagcacgacggacacgatcagggagtccagagccttctacagccagcggcagtttgttccttgcgattcgcgccatatccagttcattctgagcagcccgaaggatgctagggcgaattggggacccttcataagccatgctggccataggattaacctccaaatagtttacttaggattccagacttgggttgctgtccgaaaccgagttcttctgcgctaggaagaatgcccattcccgctcccatacctgctgcaacttctgctgcgcctcgttcgcttgctcccctagccccttcgacagaaaagcttggtactgcttctgaagaaggctcacttccttgcccgaggagagccgcgagtgctgctccgcccattgcgccaaaagggtttgattgtccactagactctcccgattgcattgtcccaaggtgggtggggcggtaggaaccttgacggctcaactgtacccgctcctgcccaccacctatattctgtcctatagcgaacagcttctgaggaagggaggccattagaacagaaggcccccgaccctaccaccagtattcataccaacagaagcacccgctgggccaccgaagagagcgcccaaggaagcaccaccgagagcacccagggcagacccgaggccaccaccaccgccaccacccgaggaggtagtaacgttggttcctcccatgtcaccggagataagctccttgtaggcgagtaggtcgttaaggctgacgttattctcataggcccacttctgtagtgccccattgatctcctgctgctcctgattctgaagcatactaccagcatctacctgcatggcattaccagagccgaggcccttagcaatagccgacaggttacccagggtattcaacctattctggttgtaagcctgctggtcttggaaagccaactgggaggcgttattctgttgattctggagcaacctagcggtagcaataccttctgctacacccgctcgggaactcccatactgaccagcattagtggcccctgctcgcaggtctgggcgtaccgtagtgtcgaagtcccattgcatctgctcgttggctgcaccaatggcattcgccaagccagttttgttgggatcgtaaggaccaaggtaatcagccaaagagctaacacctgagctacccaggagagactgaagggcacccccgagaccacccaacccttcgatgccgccaagctggagagcattttggtcagccaccgggtcgaagttcggatcacccccatagttagggtcaaagcccccgttatgtagccaatcactggcacccgagagtagttcattatagttaccttgctgatagggtgtagagacagaggtggtcttttgcttcttactaccacccttgtaagcccgagaatctagggcatcctctacatcgaaccccatcagacgctttacgttaaattggaggaagttcatctggagttacctcacgatagaaggatacggagtcttcggtgtacccgagtttctctagggtaggcttccagccccgacgaccttcgcattggataaaccgacagttaactcgttgggcgaactgtccgaggaagtcgtctacctccgagtaatctaccggggtttcattcccaggcatcttaccactccagaagaagtgaaggatgttacccaggggtgcttgggacacttgaattacaccagcgtagccactctcttcctgatagaagacataggcttcgtagttaaccaaggagtggaccaagtgttcgaagtcccaaaacttaccgaggtccgtcctattgaaggctcgggccagagcagggactacggtaggaagcagatcgatattctcacgagtaatcaaatgaatcatggagtcaccaccagggggaatgtgaatgtacccccgaagactgctccttggggaattccttggattagaacacggccattagctgtgatcttaaacattgcttggttaaccaccccagtctgaatagtagccctgttgagaacatcaaagacttgatccaacggaggtgcgttagggtcagacggaggtggataagtaatagtgctctgcgctgggatgatgctggaataggccgggataaacaactcagcagggggccaatacgcctggggaagatccaggacagtagctccattagtgtagttaccaccagacatgagcatggttatccatacttcatccttagcagtgttcatcctataggcacaggtacccatcggttgatggttgttctgtggggtaaataggataaagtcccccggcaggtccttgggtttagtacctgcgagtctccattggttatccaagtcgtaatgatagatgccggatactggacctaccactccgggggcaaaatactttacagtccctggcttgagcttcttagggggctccatagagaccccccagtagccgtcagctaggtcattaagagtctgtccaaccctaacgaattcttcattaaggaagggcagcagttcctcctcttcctgtggtggaatcgaagggctgtacttttgactcatcgcatacctgccttcggggccatttcaatagtgtacccattgaagtaccaatccccctccgaagagaagtcgaacttcaaggctatataccggcccacatgtttagtgtcaatcttatagtcctgaccaatccggtatgggtaagggcctttccatcgaataccagaaccttgtacctgagcgttacccacccagatgttacaagtaccgttaccagtaatgtgtggaatgatggcactcactgtcttcatcattcgatcatccccgagatagatatcggatctctcaagggtactgacgaagttctgtccagagaatgtagagttattaccgaagaggaacaatttcttatcctggaaagatgagaagatcatactggactttgctgggttataagagccttcaccccagaccgaagtataggtatcccaggggttggggtcgtcatcccagaggttagacaccttaggatcgatgatcccgtaggctccactgagaacgttgggaaggtctcggatactccaagtgttttccttccagttccagatgatagccctatcgcagtgcttacctggctcagacctagtagaagagtagcatacccacatttcagtattcacgtggtctgcaattacgaaggtccgttgatagttgtcagggttaatatccgagaagaagaacttacggacctgagcatcaataacagactgcttctgcacaccgttgtggacatatacgtcaccgtggcctactacaaagtggttaccatcgaactctattgcacagttgggtccgaggatacctacgtcgttaaacagctgctggaattggaagatgaacaatccaccgatataccgcatggagtatacagagtcttccttgtagataatgaaggagtcacgaagcttaacaccatctacgatggcaccattggtatcagccaaggtgttctgaccagcatccttagtagggtccgttgggtcccaagatacaggaatacccccagcatcagccgaggtactccaccagaccatctgtggcatttctacagagttctgggttacgttcaaggcaatcataaagttcttgaacgacttcattcgtttagcgaacgtgttagccggccagttaggcatgggaatgaacccactattctgtggcatcaacacgtaaggatagttgcttgggttgttagcaaagatgacaccattgaatgaaccagaggaccatctactggttacacttgcagagtgtccacctggggatacatccacaacggtagtaccatccgccaagtacatacgctgttcgccacacaggagccaataggggatgttattccggatgaaagggaacatatccaagattggggcctgggctgtatcaaagataggcgtatggcccagagccttctgagccttgccgttcttaaaccggacgttgttcccgaaggaccatttctccagtggcaggtcagcgggggcgatatcggtcacaatccccgtagggttcttgacctcttgtctctctagggccattgtatacctcagttcttaatgatgaagaacacagaacagaacggtgggatattacccaacggcatgttgatctttactgcatggttgtgagtctgaccttgaccagcagggccagtctcaaggttggtattggctgcgttaccagagccacccgtcagagcacccgagtcacccgcagaaccggtgagggtagtagcccctcgggatctccaagtgtgggtatgtgctgggatttgggctagggtaagggcagtcccttcagtgaacccatcccatacaatgttagcgctaccgcctctagtacctacagcctgggaagatccgtcgataccccaggggaatgcaccaatgaggttggggacggggataccattagaggtagtccctacaccattacaaagcttccaacctgctgggatctgagccagtgacccagcccacatgataaccatcccaggtttaacatactgggttgtatcagcgactgcgtttagctgggctgccgttacagtgacagcctgagaaatattggggaaggtattcttaatagcactcttaatgagtcgcaggtggtcatccccaaaggacttcagatcagagccggtagggttcgtaggcaccaactggttaatataagttgcgacctcaagacccattcttggcctcctttatctcttctttcatttcttttcgggtgacataccgctccccaaagattgccatagaaatctggagatcgctcaccgctttggtgagcttctccgtggcctggatgtttctttcaagcagagcctgatgaacattctgaccgacaaccgaggaacctaccgtcactaccgaggatacgaccagggcactgacgatgctgcccaggttatcagttagaagttgcatcctccgtcttctccttaaggttgtcttccaggacttttacgaactcgtcgtcaaccttagagttagtcttctccgccagggccttagcaccagtcacgattgacttagcgattaccttggttgggaagagggtagccagaaggttgattgcgagggtttttagaaagataggcatctgaagctccttaacgttcaatgtctttgatcgccagtcgagtgctagcgaagtcagcggcattctcctcgttctggagttccataacagcccgttcgagtttctgaccccagaactgggaccgagcttcatccatggtgtacagataaatctgctcaaggacaccatagagataaatctgcggatacttcgtcagagcccaagtcgttgggttagcgaggcttagctctgggagtacagtccagtagttcacaatgaacggggcaccgtcaggaacaacggggaatactcgccagaagttacccaaccgagtgtagtaggttacaccctgaggttggtagttatagttaacatagtgggtgaagatatcttgggtgatgtactgaagagtacgcccaccgataagagagtcacccgtgatagaccttagagcaacaaagtgctcagggatctcaatgccaccaccgaaggccatgagagtttcgaagtgttcgttctccctcactcgtagcaatcggttaagacggtcagtagtgttcccaatgaacaacatcagaagttcttgggtaagatcctgacggtcagaccactggatagcagcaatagcgagatcagttacgttattgatcgtagccattcattacacccgtgcctcagaggtccgcatccgatagttatctcggtcattaagccaacgggtaaatcttgcggcatggtctgggtcacaaccaatcaggtttagatcgataggaccaccttcagccatgggacgattccgtagtgcctctacgacaaccagggggatacttgctaccttgcgcatattatccttgcggttgctattgacacccgagtggcgctcttcggcgttagcggacaggattgactcaacatcttgagtatcctttcggataaagagcccaaggtcttcgtcaattgcataagtcgattggatactcatgatgtacctcctaaggggaaacaaagggccccgaagggccccgttgggttagacctgggctacaacgtcgcggatcagagcaccggacttctcgttgtttacacgcagggtgtactcaaccagcagctggcgcttctcgctgtcaccggtcttagccagttcgtgctggaagaacggacgcaggtagcagagggcgtgcatcttcggatcaaagatgaacatggtgttttcgtggaaccagcggttggcacgaatggtgtacttaccgaagtcactctcgtagacatccacggtctgcgcaatgcggttgtccgaggcatccagggtgatctcagttgcacgacccttcatgttcttgctgatggccttcttgatcgagctcgaagtctggatcgagttagcctgaccaccgttgcgccagatagcctcagaggcattcaggagcatgtcttcggtcagaagacggaggtcaccagcggtaccagtgtcggaaccatcaccagttggcagggtaccgttagcacctaccgaaccgttggtcttgtagtaggcaaagatgtttgccatctgacccggagtagtggtgttacgctggatcttagcctgaggggcaccgaccatggcgtattccatgtccagcttcagttccttcgacttcttagccagctgatacgccagttcgttcttacgaccagccttcttgaccttatctgcggtaccggtgacttgcagggtctcgtccgagatttggcagaagttgttcagcatggtggtgaagctaccagccttgatggttgcatcctcaccttccactcgggtgttcttacccggctggcggagttcatcagtctgccactcgtgggtgatagcggtagctacgcccttgccgatagcagtcatgaacggggtgtcatagggtgcgatgttgtagatgatatcgataaggtcttcgcgcttaccgttgatctctacagtcgagacggcattagttggagttgccataagttacgtttccttctattagaaaatatcgagagaggagaagagagcagcagcggcttcaaccgactgatctttcctcagattagcgcgggcagctttaacccgcttagaaccctctgaggcttccgccctacgagcagcaggtttaactgcggcaggtagttcagtctcctccttcttctctagggcagccttgcgacggacctgagattcagcccacttacgtgctgcatcaagtacagccagttggcgggcatcagatatccctcggatctcatcctcggagtatccaatcgatttgccgtaggacacaatcttgtcaccccaagactcatccgtggtcatttccgggataagtttcttggctagctctgtctgacgcttaacgtaggcagagtggacaatctcggctcgcttatcctgcatagccttaatgtcattgcggcgtttaattaaggcctgggctcgatctcgggcttccagggcttccagtcgaagattttgatacttctctgggtcctgggccttaagctgctcccagtttacattgtcatactgattagcaccagcaatagcggtaacagcatactgctcaagctcggccagtagattagagcgttcagcatcaagctcttcgaatttagctgcatactgatcctctagttcagcttgtcgagttacgaactcttcattgcgaaggtagccactcttaagctcttcgaagttaacctcgtagacttcatccccaatcgggatctcgaagagtttatcctcaggatcttcctcggactcaacctcgggatcttcctcagaaccctcttcttcctcctcggactcaacctcttcggtgtcctctggagtaccttcgtctactacctcttcctcctcttcttcccctacgactttaccatccacggtttcatcaccgggggccaggaggtcatcacctagcaaatctccgaaggcttccgctgcctcgaattcatccatgccttgattctcaaggtccattacttatactcctttagagtgatcgaatccaagattgcctggatacgaagttgtacgcggttaagggcgtggagctcgtggtatatcgcctcccgagtctcactatctttgggggccgtagccttccattcgccctcgatctcttcttggacaatacggaaaagctcaggaagaacgttctcacgtaccatctgttgtgccgcatcagtcagcactagactatagccaaaacgttctcccaagattatttcctcactgccttagatggcttcttagtctcaggtactttaccgtctccgatataagcagcccgagcctgagtagcctcaagatgatactccgcttcgttacgagcccgttcccaagtgaaacgatcacgctcaagttgtagttccgcttccttaagggccatttctctctgctgaaggacagcctcttgcttcttcagttcgatctcagccagtcggatctgagcctctacctgcttcatctgggcctccgcttgcttagccaaggcgtccgattgggcacgttgggcatcagcttgggctttgatatcttcaggcttaggttgtgcttccttctgctccctgatggccttagcctgttgagcttcaggagaatccgggttagtccagaagcgatccgggtctttatacccagcgttctctgtgacttccttaaggatattgtaaaggttctgctcagagactaggaccccaagaccaccaccccctactacagcctgggccatttcccagatacgcataaggtggagcatctgctggtctttgttcatgttgccaataccaacggtaaccgtcaggtcggatctctctctccagttggcagggttaatagcaacccacttgcctcgtagctggaagacctcttcctgattctggtacttgatggcatggtcatgcagaagttggaacaaacgcttaacaccagtctctgcaaacatccgggcaatcaggtcaatctgttgctcagcagcagtcatcaactggttaacactcatagccgcttggttagagtgcagggtgttttggtctagtcctcgggtacggtcagtgatacctgtccgcttacccctgtctgcctctagacggtctagcataccgtagacttccccagacagctgaggggtctccagaggcatgatagagttcatggccttaacccgaacgatacccgctgcctcgttggtcagcaagtcttcgaggttaacctgtccatccaggactacagatcgcccttggttggtccggtagatgttatccatgatgttgcgcatgagcaccgaacggatctcttgaatgtctcggatcttatcgtagacactcatcccgtggaacttatgggcaattcgataggcattcaggtcagcgaagggacggcaatcccaaggctcgttgctgatgatgtagtcgcccacgtacaggatacggcgcaactcagagataccatccccatctacgtccagaagggtgtagcactcagaggcccatacctcacggttggcttcagcatcatccccagagttgtactggagttggccagtcatatcgaagttatcacgtaccaacctttctggctgactatcagagaattcatactcatcgtatggaagctcatctagtacatcctcgggaacacccaagagcctcaggtcacttacggtatacttctcacggtgacagaggaagcgtgcatcatcaatgcaggtagccaatcgatcaaccaggaagttctcaggcttgatacaggtgactttaatctctcgcttcttcttgtccttgcgaattttaatactgtaggttccatcctcatccacactctgtgctagaatctcagtgtctggatcagccaggatatccgctaccatttcctcagagagaccagagaatcgttcgaaggtaggattcaggacctcttctacatagacctttacaacaccggtcttcatcatcagagtgtcttggaaccagtcgaacattaccttgaacccctcgttcttacgcatgaagaggtagttcacatactcagtctcttgctctgcctgttcaacatcttcggcagtctgaggttcatacttaactacttgaccgcctgacgtgaataccttcataagagaaggcataatccagtctacagtctcttgaacatccctagatacaatcgcggacttacccggacgctcattaccgaagggctcaccgaagtaatacttcagggcttcagagcgttgtttagatagttccgacgagttgaaatcaagggcgtcgttaacaagttggtctagatgacgaagtacctgttcatcatccataggcttaatcttgcgacgacgcttagccattagacaatactcccaaaccaatcaggggtcaactttgcagtatcactcctgtagtatccactgtttcgtacagcaccaggacgtgcatgccgggaagccatcaacagggcataccgggtagcggatatcatatcgtcgtttctgtcgataatctttccgtcctttcggtggtacattttcatttcttttaggaagttcgtacacgtattaaacaccttcagatcaccattctccatacgggtcaacatccagttaacgccgaactctacagagttacctccgtgtttaccatcaggacccggtgggttactgaagggctcatacactacattgaggttgtggtcatctttaagaaggtctacgaatctacgaccagaggttgctccatcgtgcttaaaggcatcgtgggggacaactaccgggatctggtgaccacccttcaggtagatagcatcagcgtgcatccccaaggtctcaccactctcacttctctcatcatagaggtagtatttgtctttctcagggtcccaggcaacacaggcgatagcgttagggtggtcaaacccaaggtcgataccgatgatcctatggaagtgatcggggatctggaaaggctcacatacaaacttctcttccagaatggggaagactacaccagatccgagcataggaacaccctcggccctcatcctgcgttctgctggagagtatacagagagtagctgctctttaacttctggactgaggtgtggggcgtcttcccagcttgcatggacaaggaactgaccaggtttaagatcctggaggaagtccttgacgatctccgtcagaccatgctctggggtaaacgtcagatatacaatacccccagtagtagccgttcgggttacacactgggtataaatatccttggggcattcctcatcgagccagataacgtcgatggcagtacccatgaatttgtcctgggacatttcgtaggacttgaagataagggacgagaggcccccggaggcatgcttaacaactactgcttgcacacatccgggtttaccttccctacgaatcgtctctacgatatcttccttggggatcatccccgttccaaaagcctcagggttcttccagtcacctagtagttcggactgaagaatatcccgagtggtatccgtggagatccccgccgcccagcagttcactggacgatcatactttctaccagtccaccactcagggtagcgaccggtgaggtggcaggccatgataaaggccccggtgtaggttttaccacagcggttaccagtcatagccagcaactgggcgcagttcgaggaagctgcgataaacttctcttgccacccataaggagtgtactggttcatgcggaaatacttctgccgctccgccaactccttgactagattccgtagccgctcttgggtatccattagaccaccttgtcacctactgttgatgcacgccacagggcccgttggaggtcccttacgcgcactggagtttgtttagcccagaggctatcttctgcctcccatgcagcttcatcaaaccttccggacttcaggagattccacgtcttggggaacttcttcgtccacgctgtacccagctggaagttgacgctaacgagggcatcgaatagctctggagtgcaaaaaggcagctgagatacttgcccttgggctgcatcataggctgccttactatcttgctctagccaagtctctgctcgtgctagggtaatcggtccgtcttccccagggagttgcaagtggccataaccaccagttatcttcccgagggagtctttgtaccattttagtaccaacccctcccttcgcttgattagatcaaggtacttaagaggctgggaaagaaatgactttagccaactctggctcttcgtcgagaattcgtcgaacttcactgattagatcctctgcggacatatcttccacattcttagtagtaagctccagtttctgcttagctccgaagcctccacgatccaggatatcctgggccgccttgaggcgaatcccacctttctcttctgggttgctagcgatctctacaaccacacgaagcgccatggggacatgactcccgatgcgctcagagataaaggcgttgatgtattcggcatgctttcgatggtatgcagctacgttgcgttgcgcatgattaggagagaacccagcggctatatatgcttgggttttgttcataccatctgccagagcctcacaatagaggtccagcttttctttagcagaaagaggagcagccccaatcgagacaaccttttcgtctgacatacactgctccgatctctctaaatggtcaccccggtaggactcgaacctacgacctcctgtgtccaagacaggcactctaaccaactgagctacgaggagttaatggtggtcgaaggaaggaattgaacctctagcctaaggcgtccgggttacaaccggatggtagtagccatctacctctacatcgacctctgttggctgggacggcagggctcgaacctgcgacctgagagttaacagctccctgctctaccaactgagctacatcccaatgaaatcttaaggtaatttctcaaccttataatactattatatcatactttttctattttgtcaagtcttttttcttctttttttattttagtcgcaaggcccggttttgttagggtttttgctggaatgggaaaggggttcttaagactatcttaagataaccttaaggtaactaaccttcttagtaagtaagtcaaaaggaagaaggaatcttaagagcctataggtctattatactacattttggataccttgtcaagcactttttgatatttctttgataatcacatgatttacccgacgaacggtatgatagggttctatagatataccctaagactacccttcgtaggttgctggtaaggggtaagtggcatagggttcccttgatccaggttctataggtataccttaggactacctctgtttgctatgtcctggcctattgccccctatccagtaatataccaacaggtatcgggggttgcctttgatccagggcctataaccgggggataccccaaaagtctattttatcctccggtgtatctggggaatatccccccaggagtcccccagataaagtgggggtggcctatccacaggggtatagcccctagcccctccctaggataccatgggattagtccgggggtcaacccttagacccttgggctaagccccctagagctaccgttcatcgggtggacactagggtattcataagaaaaatcttagggtattcaggaggtggatcggggggaat

SEQ ID NO: 7 - DNA, 73667 bp, Podoviridae Litunavirus
  misc_feature (1)..(73667)
ggatgcagtacttcagtctgcggctctacaaatccggttatcccccccggtacctctagagttttggaattcccgcgctacctaccccaccttgtttaactctccttctacccaatcaactgtctgtacttatagagcaagagaagccttcggctgtgctgtggattgatcctgtgtcaccacaaccattctcactactctggagtactaccatgttcaaagctctcaaccaattcttcgccatgctggaatccatgttccgtgctgtcaccaacctgaccaaggctgcggagaacgtaaccgagtgggctgaagaagagtctgctcacttcaacaacaaggctcgtctgcaacgtgaacaagccatcgcactgctcaacatcgagaacgctgctgagcttcaggagaaaggtctgaccgaagctgtcgagtctgtccgtaaagaacgctccaagtccaaggcttaacctctacccagtatccctcactccctaacacggagtgggggatcacctttcaaagcacacataagatcaagagcacacacaaagcacacatctctctcagggacagtaggttgtagggagatagggatactctctctgttggttgttcactctctacctaacagtcatctctctcgtgtgtaggaggataggggagatatgggtaggtgcactgcatctatctacactgtctatctccctaatctctaccttcctcaatccgataacctgtcatcactttccctcctacccgatacactccgtgttcctatctacacttgggtagtgtctgatgttcctctacaccttcggtgatggagtggtattcgattctgtacttacttcatagtcctctataggtatcaaccatggaccagaacatctacaccctgctttacaccaacgagtgtctccactccattgaacgtgagttcgaagctgactctgatgagtatgctcgtatcaaggcaactgccatgtgcaggggtaacgaaggactctggtctggcatctacctgatcaaccctcaaggcgaaacaatcaccttcgatcccttctgactggagatcctctcatgtccaatccccatagcgtgttccgtgtcaacaagtgtcacgtacgtatggttaccgatggtgaactcatcacatctcctaccatccacaacctggaagagatgcgtgactacatccgcaacaactgcaagccaactgacacaggcatccgtctctcctacatgtctgaaacagaaggctgtgaagtaatccttgctaacttcgatcacaacgggaaggtactggtatgaccactctcgatcaaaagatgcaggaacaagtctgtttcgtcggcttcactcgtggtggtactgagtggctgtccagccgtgtccaatcctttggtgaagccaagcacttcatcaccttcaactgtagtcccagtgacaaggacatccgcatcttctactacgtgtcagaggatgtggaagtagtcattgctcgtctcaacctcaacgtggatgtggagatcacccaatgaacaacctgcgctttgcttaccgtggtagtactgtccaatctcttgcctgcgaatgctgggcacgcaacctcagctatgacacctgcgtatctgtactgtctcagaatggcttcagccctgttcaatccatggatgaattccaatgggtctggaaccagatggaccaagcctatgccaactactgcaatgagcatggttaccatggcgatagcgaaggctttgctgacgtatggagccaccaatgaagactgtcgctgaactcatcaagcttggcttggagtactaccaagccaccgagaaagcagaaccctacatgtgctttgtcctgcatgacatggccaggaaagaaggggttcacccacgagtcactattgaagagtaccagtccttcaggaactggctccacgaagaactatacctgcgtccgtcccagtctgtccttgacaggctggaggtcaggggcatggacaataccttagagaactgggttcagttctatgtctgggcctactacgacctcatcaaaaggaacacccatgagcaccaaccttaatctcactggccgtctattcgacatcaagatcatccctactactggaaagctgactggcttccgtgtacgggtgaccttgatcaacatggactgcccgaacactgtactcacccacgtagtcatgtgtggtgatgagtacaccgccaagaacctgaagactgcgatccttcagcgtcgtcggctcaacctcaagcactggcattggacagaggtcaacaaagaccttcctggtgcctgtaccaaccgtctcaaaaccaaaccctttaccctggagatctaacccatgctcgctatcgcctgtgtcgtactcatcctgttctgtggctacctgttcatgctcaattgcttggcctgcctgacctgcatcggtgccctgttcgtactgcgtgggaccgataaggtccctgctgtagttggccttgcctggtacttgttctgggcagccgtatggggcgctgcaatcaacttcctcttccacgtcgcctagccaatcccctgaaaccaaggagtccatcatgactatcgttcaactgttggccgtcatcgctgtcatgctgctggtcgttccaactgtgctgtccttcctacgcatgctcgtatgggctgcggagacctgggtacgctgtgagactggccgtggtaaccgtggcactgctgcggtagccactgtcctgtacggcgtgtccatgtgggtatgcctgtacctcttcttcctcgtgggggaatacctgtgatcgttctcatcatgttcctgctgttcgctgttggtctgtccatgctggtgatcggcctgcacaggcagtgggtgatcaacgagatgctcaggtttcccctgagtgtctcccgtcgccatgacctgtgcatacagagaacccatgcctgggtcattgctatctgtggcctcggcctgctgtttgcaggctgtggtcctctgttcatcttcctcgctggaggtctgctgtgactgacgtagagatcctcatcctactgtgcctgtacatcgcttcgtcagtagccgtgctgaatggctacatgaagtggtccagcaacaactacaccatgcaacagacctggatgggtctggtgatcgacatccttgtgatgcacatcctgaccttctccgggatgttcgccctgattggggcagtgtgcatcgccttcaacttgatcggtctgctgtaagtactcatggcctacggccatggggtggtaatccaaaccatctcaactcactgtttacttaggaatttcatcatgatcgctctcaacactcgcaaggcttcctccatcctggatcgtggctaccgtgaatgcttggacgctgaagctgtcgctcgtgaactgcataccattggtatggcctcggtcacggaagaagatgtcctgaaccactgggctgactgggacaaagacctgtccgacgaaccccactgggtgtaagagcaagagcaggctacgcctgtgtaatggctcatctgggccgaaccacttctgatctgtatctaatatctctccctacaaggaacctgaatcatggcactcaagaaatccaacgctcgtaccaacaccgctgctcagtccgacgagacccgtgctgcaagcttcatcaacatctccatcggcacccgtggcggtgatccggttcgcctgggcaatggcattccgctgcgcctgagcgaagccgtcgaagcacagctgcacgagtacctggccgaagccaaggacgacaaggaactggccaagcgcatcgagaacctgcgctcgcgcctgatcctgtccttccgcatcgtgcgtgacaagtccgagcttcagctggacctgtaacagcgtccgcccacaccctcactcgatcctgagtagggtgtgggctggttttttagagtatcggtttgggacagttgaagagactgtccaagctggtccgtttgatcaaaccaatgaaactcatctggtttcctgacgatgaagtaaaagtctggaatcggcactttctggctggagaaacgatatgccaactgcactcgaaatgctcatgagcggtactgtaagtggtcttgagttggaccctcctaccgcaaaggctttggaggcactcaacgcaggcaagaccattgtggtggctgtgacaatgctggagaaggtagccctgtacatggagtgcctgaaccctgggaagctgttcgaagaactcgtgcatgtggacatggatgagatcgaacagaagttcctggtgaccctggtgaagaagggggaatgtcctgcccagaaacccaagggtgcacatgggatctccaagtgggagatgcctgtgcgaaaccatgaaatcaaccacctgggcaaaggcccgcgtaacaagttaggaggcttcaactgatggaaaccaatcacatggtgttcgtgttcggtagcaacaatgctggcatccacggtgctggtgctgccctctatgcacgtaacaacaagggtgcagaaatgggagtaggggaagggccgactggcatgtcctatgccctgcctaccaagtacaaggctcacggtggaaggctggtcacctgtcacatcagcgacgtagccaaggccgtacagcggttcatggacttcgccagggagcacttctacatgagcttccaggtgacccgcattggctgtgggcttgctggcttcaaggacagcgagatagctccgctgttcagtgatgcacctgataactgctacttcgacactgcctggacttcctggctcaaaccaaccaccaagtactggggaactatgtaatgactcgtacctatctgaagcgtgtagtgatccgtgatgagcacggactgttcgttgccgacggcgacaccctcatcgacgcactgcgtgaagtgcagctgaagcatctgctcaagcagttgaccgtactcgaccaagacgatggccaccgctggatgttccagttcagccacgtcaacaaccacatcgtcctgaccaagcagtctcctgactgctgtgacgggatcatccgcatgggggatctcctgtaatgcctcagttcatcgtagggaacatgtgggaagtgttcgatacagctgaccacttcatcgtgctgagcaacagcactctgacctcgaccggtgcagtagtcatgaccgctggtatggctgctgagcttgtaggccgcttccctgatgctggtatccaaaccagcgtggggcagtacatcgccgagaatggaggggctggtggcatcttcgggtgccgctgccaatccaaggtaggcgtgttccaggacaagcgtcactaccgtgatcccactgacctggggtgcgtcagcaccagcaccactcagctgatgtggcgggcacaggagaacccaacccaccagtaccacctggagcagccaggacagaacgagccttggtggctgatcaaggacatcttggctcgtctccccgacaacgtaaccatctggagccgtccctaatgggatggcttcactctagtgcaatggaggtagttggcgatgaggatcaatacgcataacaaggacgcttatacaacggtgaacatgcaggagatggagcaaagcatggcccgcaagttcactacgatgctgatatctgactctctgcgtaaaggggagtcctgtctgtacatctttgatggtttgacagaagaggtattccgtaaagacctttccaatgtagctagtggtctgatgatgagtagactcaagagctacactgatccgttcaagcaactctataccaagcacaatggcaggtggttcgtcttcagcagtgacttcaatcctgttgcagagaagctagtaccaccagagatacgtgcccaatcacttctgttcgattaaggaatcgttccatgaccattacccacatgctgcccgaagatatgcaacgcgccaatgaataccgctttgctcgggcgcacattgacgggtacatccgtgagttcattcgcggtgacgaagaccttcctgcactgatggagcaggggatagcactactggaggagtatcgcaccactgagtacagctatgcctccaagaaccttcgtatggagactgttcgtaacctggaccttgagcacattgtgttcgagatcatcgtagcgtctgcgtactgtcaggtaccggacatgtttatcagcttcacagccaagctagctggtgtacttggcttcgacgacaaggctgacagcatcaagaccatcgctgagatggttgcagtgctggcagagcttgacgtgtacgacattgagcaggtgtccaagtatggtacatacaaggtcatctccaacattcaactaccggagaagctacagcatgctgttgagcgagctatgtaccttcctcctatggtgtgcaaaccatccaagctcactggtaacaagtcgaagctgtatctcactctggagaaggaatccctgatcctgaacaacaaccatcacaacgaggacatctgcctcgacgtgctggataagatgaacgctgttgagttgtgcctggacactgagttcttgagcaccgtagaggaagagtcccacaagtacttggacacgcaggacaagaaggatgactggtacaggttcgtctctgagtcccatgagatgtacaagctcatggttcagcaaggcaatcgtttccatctcctgcacaagtgcgacaaacgtggtcgtgtgtatgcacagggataccacatcagtacccagggatcaccttacaagaaggccatgctggacttagccaacaagaaggtggtcactggtgtacccgaacacttgaagatcaagtgaaggagaaaccgaatgaatcactatgcgttctacaaagaagacgatgcatggaagtacgtcaagtacgatggattgcttgagcttgtgcaagctgcgtcaatgatgtcctgcaacccacaagaagcagcagcgtgtacctgctacaaactgaatggagtcagatggtggtggatgggcatgactgacaaagacgcgatagaggacgtgagtcttctgccagcagacctcaaggcaatgctggtcatctggagtctcgaccaactactggagtaaactaatgacaatagttgtatatcgtatgcatggtaaatgggaaatacaggaggtagaactcttgcatactgccttaaggctagaacttcacacgatggttcatagcaacaatcgcctacctgacttccgcctattagtcagggaaaaggcaatgtactacgctggatacagatggtacgagtgggaatacgatgactacagaaaaagagtgttctacagaccagtggactattgtccatcccacgaagaactgataaaggaactggaagccctaatactagtagcggggtactaaaccgtgcacatagctgcttggcttgaagatggtaactggcgaatattcgccgatgaacagagggggctggtcaaggacacagcctactaccaagctagccttgtcgaagacctatatgaatccactgtgttcctctgtggtagagaagaatggtacataaagggtaaacctctatggttccagttgtgcagggcggataagaatccgtatatgcgactttacaccaaaccacttccgaaagaacttgaagcactgttgatcgtctacggtcttcagtaataaccaaccttcgtttaatgggaactaaaccatgactccttacaccgctttcgaatatctgttgattgatgctgcaaaccaaatgggccatgacaagtggctcttcgaacaacgcatccaatggtgctacgacaacttcgacaacctggagaatctggagtgcaacgagaagactcgtccgcagtatctcaaggctgtcatggccatccgtgctgctcagcgtggtgagcctgttggccacctggtagggcttgatgcctgctgctcgggttgatttctagccccttcatggagcaatccatgtcgatcacttccttaattgctgggaaccccttagagccacgctaccactgcgagccgaaaggcaaagcgaaggtttgaaaagtgtgtggattgggcaatcagcagccaagctccgtatgggagaaggttcaacgactaggcttaggccgtacacccaagtgggtggaaatgggaagcacccttctggggtgaagatatagtcttgcctgtggagaaattcacagcagtgtcagtagggcgtggtaacatatgcactccagaacaactaggaggtcacatgaaccactacgcttacttgcttactttcgcagacgggatgtactacataggtgcccgctcgtgcaagctaccgccagaattagataccacgtatctcggatctggtaggggcttaccggtggaccgaaaagacaacccgcctgtgaaaaccatcttgagaaccttcaatactcgccaagagttgatggacttcgaacggagttacatcgaagaacacaactgtgttgcgtcacccaactggtacaaccagcgtgttgcaacgcatgaccgccatggttccgtcagctggaacaaaggcatcagtgtggatcgtactgaagcaggtaaaactttcagccgtcgctataagggtaatcgcaccccagcgatgattgttgctcatgcagcgacggctgaaaagattcgtggaactaagtgcaaagacaagggccatgctggtacctcaaatacagcattccagccttggtactacgtgaccccagaaggggtttacgtagaaatccacgaccaaaccaagaaagatgtagcacctactttgggacttaaggaacatcaaatagccaatcgcatgcgggagtgcaatcagcacaaacctgcaccgacgaaacctttgaaaggttggatatttggaaatctcccacgtcctgctgacacggcagaagattaacgaccttctgtgaaaacaagcgatgcaaatcatgtccgccctgggtggttgtgagtctggtgcccaagccaccaacctcatcaacactggcttccgtcaggatgcctatagcctggtcaccactgctgcctctacccacctgggggagtccgtaggtgagatcaagcggtcggacatcaagactgccaccatgacccacttctatggttccaaggctgagccgaagaacctgttcggcgaggacactcctgaactggaagccttctaccaaggcgtggagatggtagctcccatcgccaacgagatgcgggatgacctcatcaacacttggcagccctacgccatgaagcactcctgggtgctgccggacaacttccactccatcgtcaagtcggtagacgtgttcgagactcgggtggaagtggacgagatggagggtgcaagcttcgagtacatctacaagcaagactgtggtgtagagcgtgctgtgaagaatgctgccaacgtgatccactccatcgacgcctacgtgttgcgttccatgcaccgtcgctgcaactacgaccgcgaagccatcaccaaggtaatgcagttggtttggggagaactgatggaccgtcactctggtgagtgtgaagccggtgaaaccctggacgacaagctggctgtctatgaagacctgtacgaccgcaccaacatggtcgatgcagtgatcttcaaccacatcaacgttgtcaacgtgcgtcagctggagactgaccacctggaagctctgtgtgccctgtgggacaccatgcgggttcacgaacccttcgaactggtcaccgtgcacgatgagttcaagtgccacccgaacttctgcaacgagatgcgccagcactacatcaacatcttcgccgaactggccgacagcaacgtcctcgacgatatcgttaaccagatcactggaagccatgtcagctacgaccggtcgatccacaacctgtccgaactgatccgtgaaagcgagtatgcgctgtcttgaggtgagtgggcgtcttccagacgctccatgaacccgaatttgcctgatcccagaaatgggatcgggcgcttatttttttgaggggagcttagaaaccatgagtaaacacaggctatgcaagtactgtggtaagccaatagtgctggtccccagtgcagaagagagggccaagaagttcggagagtcgtccaagttctacctcaatctcttctatgcccatggggattgcattgtgaagagtcggggttgagcgtactccgtacgctttttgcattttcgctgattttcggcgagatcatcaacagatagaaggagtaacaccatgcgcaaatcgtacctgaaattcctggacaccatggcttggatcgctgctgtcctggtcttcgtagtcgtggcagtcgccgccctgacagtctacaacggcatcgtcgccctgctggtaatgctgggtgctgctgtcggcatcggcatgaccttcgggttctggttcctgggctacggcatctacgaggaactccagaagctcaacgcccgcaccaaggtgtaagccatgcaggtccgcaacttcatctacgaggacggagggtggatgctggatggcatggacacctttgatcctggcgattctatgacagttatccttgactcgttcgagcacatcgacagcaccgagggccttgaagctgagttgcgggccttcggtgccatgtggtggctccgtggtaagacagattggtggtgtcgttttcctgggacggaccctcgtcctgagcaggtgatgtactacgacatcgccacattcatcatggagaacgacttcctaatcgacaacgtggggaagcggttcaagatgggcgtggacgaagagagtttcctcgacgtgctacgcaagcttgtcgaagatgccctggagagagacagtcagtacctcgacaaaccagtggcaaggaaggtgatccaagaagcggcgagcactgctatggattggcttcgtgttgggtacagggcagcccgtagaaaataccctgacaacttcgcagtcgctgacctcatgtacggcctctacaaaaaggtgcagtacgtcaccccaatggcttgggagggcagcacacttcaactcaaatacaccctcaacggcaagttcgttgagatcagtttagatggagaacccatatgatcccattcgtttcccgcaagcgtttcaatgaagccctggccagtgtgaccaaatactacgaggacaaggtacgtcgcagggatgaagtcatcaatgtacagaacaacaagttgcaggcagagcgcgaagaaactcgcgctaaccgccggatgtacgcacgcgcccagagcgataactaccgcctacagaatcagatcaaggatctgaagaaggccgtggaaacccgcgatttgaagatcgcggaactcatcaagccattccatggggaaccggacgacgttccggtaatcgtcccggaagagacagtcttcgagcctgtggacaccggcctggaaaagcagctggctgaagccaagaaggagatcgagatcctcaaggacaaggttcgcaagcagcgccgtagcgatgccgaactgaccatggacaccctcgtgcacgctgtcatgcgtgagtacaccaacttccagcggagcaacaatcccaacctgctgctccgctcctgcgagaacctgacgaaggctcatcgtcgtctggtgaagggtaaacgctgatggacaagatcacgtggttccgtcgtggggaacccatagaagtccccatcgagcgctgcctgtacttccttgctgacggcaagctggtgcagttcttgtactacgacgaaagaggtctttttcagattgcccatgtcaccggcatctctgtaggcaagatctatagtgccgtcaagggtaagttcgtgtacgtccgtcatggcttcatcgtcaagaacgaaagggttggtatcagcctaggccatggaggggacttccggcgtcctgtgggcgtttacgtgaagggtttcgaacacatacgtagttcgctgactgtcggtgcccaggaactcatcactgcccagctgttgggtgaccacgtaaggctctgcaccaagcaaaacatcggtggcactctggtaatgcttccaggggagccgggtgaacgtgtcaggaagaaggtcatcatcgaagagatcggcactgacatccaccgcaattggtgtggcaatgcctgcttcgagatcgccgtgatcgacaagcatggccgccgctacaccgaactgaatgaccactttcaactttacggggtaaacagataatgatcagccaagacaagtttgaatacgagatctctgctatgaagggcaagatgcagagattgcgtcgtcgggtaggagtactcaacaacaagcgagatatcctcctcgaagatatcgatgcaaccaacaagatggtggaaaatctcagcggtcaggttgaaacgctgttgcgggaagccaacaaggtcaagggtccggtcatgcaaccgggccgtctacaccagagcgacgtactgctcaccggccagaacattcagagcatgatggactctgtggaaactgtcgcccccttcaaggtgcaggagcaagacgaacagactactaccatcctgaaagatggcgtggtcacccagttgagcaacaacctggccgaacttctggatacccttggcttcggtaaggagcatgtccagaagcatggtatggaaacaactgtctacgatgcgtgcttgtacatccagtccctgaagggcggcgagtcgctgctgaacaatctgcgttcgatgctgaagtgatcagcgacaagctccgcaaagaattcgaagaagagtaccgccactgtgtgtggtccttcgccggggtagtcatcacccaggaagaactggcgagtaagcgtagtcgtctcggagactacgctgacaaccctttgattcatgggttcttccgaggctggctggcgggccgcttcggtatagaagggatgatgtacctcacaggtgaacaggctattcattagcgtactccgtacgctcttgtcctgtttattctttctttcattggtttaggagcaagtgccatgcattagcgttgatcctttaactaactccctgcgcatagcgtcgcataaggcgagacagtctaagtggactattagtacataaagagaatgccgagtttccaaactacacaggatgtagtccctgagtaactatcggcattctactgtgtgtattaaaccaagaattaaataggagaagctatgcagttcagcgatctcagtccggtggaacaagcactctacccaacccacagttccttaaaagaagccctcgaagaagcaagacatctgcttcctgggggcagtcatcatgacttcatgcgagccatgatggggtatcacaatacccttctactctttgtaggtgagtggaccccttccgagtaatatttggggttatgcaatcccagatttattaatattcccgtttaaaggagactaaccagtgtcccaagccaacgaaaaaacaatcgagcggatcggcaagatccttctcatcttcaaagcgtccgaaggcgagattcgcccccacttctggttgaccgggccttctggttcgggcaagtccttcaacatcatggaccagtgcaatcgcctggacatcatgctgcccatgaccgaggtcaactgtgcatcgctgaccaaggaaggctactccggcctgagcctgagcaaggcactggccccactggctaccctcggcaatgtccccaacgtcgtattctgcgacgagatggacaagctgttcctctccggtaattccaacgacagccatgccaacgagatcagcatcggcgtgcagaacgagttcctgcgtgtgctggagggcagtaccacccagaccttcggcgactacggcaagtacaacacggtcagcgtcgagcgatccctgttcatcttcgccggtgccttcaacggccaggagaacatggacgccaccgaactgctgaagtgcggcgtgaagaccgagttcatcggtcgcactggcttggtctacaacctggagaaaccgaccatggaagccctggtccagtacctcaaggaatcggaactgtgggcgaactaccgctctctgttcccgaaggaagaccacaagaaggccgagaaatggctgatcaaggaaaccggtcgcaagtaccccgacagcaacatcggcgttcgcctgatcaacaccttgatccaccagtactacatcaacgccggcgaagattccaagccccaagcgggcaagaaggagttcgcccgtaccctcgacttcagcaccgggagactgaaatgagcaagctgcaagacctgcctgtactgatcgaccgtcctgggaactacgtcactcgtgacggttcccgcgtggtgatcttcactgtcaccgagcgtcctgaaggctactccatgctgaccttcgacgctcgtggcagctacaccagggtcaacaacacgaccaagcccgagtgctggcacatcagcggtcggctgcacgctttccgggaacacccgaaagacgtagtagccaaggcttaaaccaatcaaatcaatcgtttaggagttcaacatgcacttcccccaggaacaagaagtatccattttcgacgccaagttcatcgccgaaagcttcctgcgagccggcctcaagccgatgatccacggttcgccgggcatcggtaagtcggcagtggcccgtcagatcgccaaggaaaacaacctgaagctcatcgacctgcgcctcacccagatggacccggctgacctcaatggtctgccgaacctctccggtgatcgtgccaagttccaggtattcgagcagttccccctggtcggcgacgagttgcccatcaaccccgaaaccaaagaacccttcgccggatggctcctgttcctcgacgaactgaccagtgcggatgacgatcgtcaagcggcggcctacaagctgatcctggatcgccagatcggcaacgaggatctccatccgaagtgcctggtcatgggtgctggcaacctggaaaccgacggtgcaatcgtcaacccaatgtcgtcggcgctcatcagtcgtctgcaccacatcgtggttcgcaatgacctgaagcgctggttgcaggtggtggctcccaagctggacatcgccaccaaggtgcaggcattcctggagttcagtccccgtgcgttctacaccttcgatccgcagaacagcggtcgggtctatgcgtgtccgcgtacctgggaagacttctcgaagtggttcctgaagatgtccccggagcaagacccccgtgccctggacgacatactgaacctcgctgctgccatgggcatcatcggtaccgtggccaccgacttcaaggcgttcctggcctacttcggtcgcctgccgagactggaagagatcctgacttccccgagcacgatctacgtgccgaaggatgagccgggtctgatgttcgccatgtgctcgatgctggcggataacgccaaggtggacaacatcgagaagatcctgatcttcctggatcggttcaacccggaccacatggtgatcactctgcgtatggcttgccagcgcaacaagggtctcatccagaatccgcgaattgcggagtgggtgaagaagaacctgaacatgttctaaaggagaatccaatgagcggtcgatgggaactttttatggttcgtcaagaagacccaatagggctggaaatagttggcgaatacatgcaaaacctaggccctcgactgctcactggagatttcgagggctggcaagttaatgtggttgaaaaaaccgcgagtaaccacgtagttagtagggttacagaagtaaaagaacagctacatgctgaattttgtccgcacgtagttaccattaaacctccagacggcttatatgcgacccctggtgtttatataggtcactgccgtagtagtggaagccaatacaatcagagtttcgctggattaggggcagccacatcttcaattaatgaagtggtggatctaataagaataaccaatccactaaatggtcactggatatctgatagggaagaagtttttatagctcaatccctagctgttgcttccttaatacctgaaacccacaatcaagttgagtggtgcaagttcgctaaggcgatggccatcatcggaggtgagtaatgactgatcgttctgctgaagacatcgccctttccaaggcgaagattcgcatcatcggagactccaaggtgagtttctacgccaacatcatgatgggcctgaagtacaagtgggaagatggtatgggtactgccgcaatcgacggcgtgaccatgttcatcgaccccaagttcttcatgtccctcgacgagatgagccgcaagactgtgatcctccacgagatcgaacacatctggcgtcatcacatcggcaagacccgtatgggtgaccgtgaccccatgctgtacaacatcgcaggggaccacgtgatcaacaacaacctcttggcttgtggctacggccccatctcctggacggactaccggacaggtgccaaatgcaactgggtgtgcgatccccagttcgccaacatgtccaccgaggacgtctacgatgccctctatcaggagcagaagacccaaggtggtggtggcttgtcttcaccaatgcagggaaatagcggcaatggtaacccggtgccgttcgatgacatctcccggcctgcaccgaccaaggacgacggtactcccatgtccgagacggagattcagggagccatcaacgacctgatcctcagtgctgcgactgctgcccgtgccaatggcaatcctggctccattccaggcgaagtgcaggtgttcatcgacagcctgatgttccccaagctgccccttccccacctgctgcgtcagttcttccaggtggttaagcgtggtggcttcacttgggcacgtcccaatcgccggttgataaaccggtactacctgccgtctcgtcgcggtaaggcactccttcggattgccatcgcaatggacctgtcggcatcggtcagcaacgaagagatccgacgctacctgtcggagatcgccaacatcttcgttacgctgaaaccaacacagctggatatcatccagttcgacgcttccatccgttcggtggatacagtccccaacctcaatgccctcatgaacatggagttgaaaggccgaggtggcacctccatcgcccctgtgatgcagtgggccgcagagaacaaacctcacgcattggtggtgttctctgatggggagttccaccactacaacgacaacccaggagtaccgattctatggttgattcacccctacagcaggaaatcgaactggaaagccccgtacgggcaagtgatcctgttcgatccgaaggagtagacaagtctgctcccttcgtactgacgcccggccaggaagccgggtttcagaccttcatcaacttctacaccaatcccgacgcccaggtaatggtcctcaagggctggtcaggaactggcaagtccactctgattcgtcgaatcctcgacgagatggagactctggatcgcgccctgaccaccctggacgacaacttcgagccgttcgaacccctgctgacagccaccacaaaccaagcatgtgatgccctggcagtggccatgaaggagttcaaccacgaggtcaagaccattcaccgagcattgggtcttcgtctccgcaccgactacaagacgggcaagagcgaactgatgcccatctcccgcttcgagctaccgtaccggtgcctgatcgtggtggacgaagccagttacatagaccctgcgttgctccagttctgcttcgacagaactgactgctgcaaattcatcttcgtcggcgacgactgccagctgactccggtcggtaccaacatcatgcctgccttcgccatgaaggacattgtggtggaacttaccgaggtcaagcggcagaacagtggccccctgttggacctctgcaacgctttccgccacacggtgaagacgggtgagtggccgaagatccagttggacggtgaccagctgatccatgtaccacgggacaagttcgtagagatggcagaagacgccttccagcacccggaagtacacggtaacaccaaggtattggcttacaccaatgcctgtgtgaccgagtacaacaagcacttctcgaagttactgctcggttccagtgatccgcagatcggtcagaagatgctggtgaacgaagccgtcatcaacaagcatgcccagctgagcaacggatcagaggttgtgatcgaggacattcgtcccgccagggagttcgacgtagacggtttcctgctgaagctgatgcaccacagcacaaccttcttcctgcccaagtccctcaaggaccgaaaggaccgggagaagctggccagaaagatggaggactacaagatccttcagctgatcgaccagaactgggtagatctacggccttccttctcgtgcaccgtgaacaagtcgcagggttccacctacgatacggtgttcatcgacctggacaacatctgtggcaaggtacaccgcccgaatgcactggcacgccttctttatgttggcttcagccgagcgcgtaaacgggtggtaatgacaggagacatgtgatgcaagcgagaaccccggagttcctgatcttcaaaagggcagtgaaggactgcttagatcacttcctctatgctccggtgaggaaggtattccaggagcggatgaacgaactgatcatcgcggatgctgtagcccgaggtgatggcatccgtgcgttctgccaccgtggccgcaacttcatgatccccggagagaaacccaacttccgctactttccccggctgagtcgcagcaaccgagtactcgtggacagtctactgtccgagtacgacccggtgctggtagacgagcgtgactctgtgctcacgttcatcagccaggtgctcaacaagtccgacgaaccgtcggagtacctcaagatgttccccagtggtttacgggaacctcttaagagggtctatgagcactttggcttgccggtagaaggggcggaattcccgaccgaaagtcccataggttcaaaccaggaaggctgggataagctctgtacccgcgttgggttgaaccttgtactaggaggactgtgatgaagtacatcacctgggaagaacaggatagctaccctgtggctatcctgatcaaggaggcagcggtgagtcggtcagccgctgaatccacctacatcaagcaactggaaggtcttggtgttcctcgcaagaatgtcatcgtgatctcgctggattacgagggcaagaaagtatctgccaaggcgatcaaggagtgcatcaaggatcgagaccagctactgcgggatcttggagtacagtatgcctacgtggctgactccaagtacttcaaggaatgggctaagcggaagacagacgcggatttcggcaacctgtcgccacctgctggttacgatcctgggtacttggtgactccaggtgtgaaccatcaagtgctgctgttcgatcctgggcagatgcacaagctcagccgtggcttcaaagccatcgttgaccatgccaatggggtgtatcggcctgtcggatctgaccttctgcacgatgtcacgtacatctaccgtggtcacgtaagccaagccaaggaagcactgtccaagctcatggacaagccggagatatcctgtgatatcgagggcttcagcctcagcatgttcgactcaggcattgccaccatcggcttcgcctggagcgagcacgatgctgtgcagatccagtgtgactaccaggagatgatccaggacgaaaacaagcaccacgggtattacgagccgaacgcagagatgcgggaagtgctcaagtggttcttcaccgagtaccctgggcgaatcatctaccaccgtgcaaaccatgacgtgaaggttctgatctacaccctcttcatggagcatgacctcgacaaagagggcatgcaccgtggcttggagatcatgactccacggatggacgacaccaagatcatcgcgtacctcgcactgaactcaactgctgatgtcagctactccctgaaagatctggggcaggagcatgcgggtaattgggctcaggacgagatcaaggacatccggctgataccgctggacgacctcatgaagtacaacgcggtggacgcggtgactaccgtatgggtgaagaacaagtactaccccatcatggtgcaagaccagcaggacactctctaccatggcttgttcaaggacagtttggacctgatcatccaaatggaactcgtgggcatgcccatgaatccgaggaagatcacggaggtcaatactgaactgaacaacttgcgggacgggtaccacaatactgtgatgagccatccagcagtcgccaaggtggaagtgctgatccaaaccagcgagatggagaaggccaatgccaagctgaagactatccagcatccgctgagcaagttttcgcacattcggttcaaccccaactccggtccacaggtagcccgtctactgcatgaagtcctcgggcttcctgtgctggacgtaacggctacgaagcaaccctccaccagtgggggcacgctgaagaagctgctgaaccacatcaaggcggagccgtacaaggatctcatccaggccctgatggacttgggtgccgtagagaaggtcatctctgctttcatgccagccttcaaggcgggtcgaatgaaggcggacggaatgatgtacctacatggttccttcaaccttggaggaaccatctctgggcggctgtcctcatccgatcccaacctgcaaaaccttccggctggctcgacctacgggaagctggtgaagtccctcttctgtgcaccgcccggcttcctcttcggaggggctgacttcgctgcactcgaagaccggatcaacgccctactcacccaagacccgaacaagatcaaggtgtacaccgatggctacgatggtcactcgatgcgtacctttgcgttctggcctggcaagtgtgaagggatcatggatacggtggactccatcaactcgatccagaaggtctacccggatctgcggggcaaagccaagactccacacttcctgctccagtatgggggcagttggatgggtctggtgcggcaggtaggtttctcggatgaagaagcccaggagatcgaaaccaactacaacaagctctatcgcgtaagcaatgagtgggtggctggtgagatcgacaaagcgaccaagaccgggtacgtggaactggccttcaacctgcggctgagaaccccgctgttggggtccaccattcttggattgaaggcgactcccaaggaggccgctgctgaatcccgcagtgcgggtaatgcggtgtccggccagtcctggggtctactgaccaaccgtgctgctgtggaattccgcaagctgctactggccagcccctacaagctgaaggtagagatcatctctctgatccacgatgcgatctacgtgatgtggccagacgatcctgatgtcactgtgtgggtcaacaacacgctctgcaagtgcatggcgtggcaggaagaccccaagatcaatgacaagcgggttcctctgggtgccaacctggacatcttctggcccagctggcgtgaagcctgcaccctggactatcccatcaccaaggagcgactcattgaacagtgccgtgagcatactgctgcactgaaggagaaagccaagtgaccagtacctgctgggtaaacgaccacgagatcaccgtgacgcaaggcgtagtagccgtgcgtaaggacggtgtgctcgtccatgaatgcggcggtctttgggctgcctgcgactttgcgagaggtatcaacagtgctgaaagccccggacccgaggtcgatgaagtacaggagactgtacatgtcgatagcgacgaatgcggccaagcagagtgtagctgaacgccatcaggttggaggggtactggtcactacgaccggtgccctcttcactgggtggaacggcaccatgcctggtaccgacaactgctgtgaaaacggcgagtaccttcgggaagagacacgcttcaagaccagcccctacggggtgatccacgccgagcacaacatcttggcttgggcatcccgttctggtgtacccctggacaactctgtcctttggatcaccagggcaccttgtgttcgttgtgccgaaatgatcgctacacatggagttcatctcgtgctgttccgagatgatcatgatgaacccgaggggatgacagtgctggccatgggcaatgtgaaagccatgagttggagcaccctggactcccttatcaccgaacacgggggtcactacgttgtctcgaaaaccctgctcgctaactgaccggaagtcctactgggcttccttcaaccatatgataaagcacttcggaggcgtggaagaagctgaggctgctatcgcttccggcaaggctgtctatgggaaaccaacagtgcccaagggttacatcctgggcactgacatcaaaggcatgtacgtgctgcacaaggagtagacatggcgaagaaagccaaactgaaagctgattggactccgggtaagttgggtcatgcgcctgtcaacggacggtatttcttcgtcaaccgtacgactcgcatgacccacacctggactgtagggcaaatgcccgttcccgaaggttacgagcaggtgtccatggcggagtacgacagcttccgcaagtacaaccaatcgttgtccaaaaagaaactgatgcagatcatccgaggagaagccaagtgttcgaaggacgcagacgcgaaatcagagaacggatcgaagcgcgctgcaaagtcgaagacacgggcttcatcctcgacggcaaacccagcccctgccacctctggcaaggcccggattcaggtacgggcagggacggtggttacggtcgcatgagcctggacggccagacagtggccgtccacatcgtcatgttcaccaactacttcggctacgtgccgggtaagaaacagatcgaccatctctgcgggcagcggctgtgctgtaaccccgctcatctggagatggtcacccacctcacaaaccagaaacgtcgcgctaaacgcgccaagtccaaggagtaatccatgcaggtaactcaccagaaagactacgccactcacgttgtgatcggcggcaagcaagcaatttccatgggcatcagtgatgacccggccttcttccaagttctgtcgagttccctgtacacggacaagatcctcgctgtcgtccgggaaactctctgcaacgcctacgatgcccacaagatgctcggcatcgagaaggaaatcccggtcgagatcaccctctccgatgatgagttcgtcatccgtgacttcggtccgggcatcagccccgaagacgttggccccatctacggtatctacggtggctccaccaagaagcacgacggctcccagactggcggctttggtttgggctgtaaggcgcctttctcctacgtggacaacttccaggtcaccattcaccacaaggggaaaaccaacgtctaccggatgcagaaggcatctgtccagaatggtggtcggccggcgatcactccggtggtgacggacatccccactgaagagactggcctcgaagtgcggatcaacgtcaggagcgaggacatccgtcgcttcgcaaccctgatccgtcgtatcgtagccaatgctgaaatgctggccaacttcaacggcgtgcagatgaagactctgccgttctcccaagccacgaaggactgggctatctccaccgagcaggtgctggaatccaacggacatgtcatctgtgtgcgctacggggatgtcatctatcccgtagagcgggacgagttcatcgctgacgtgtacgacccggtgcacaagttcgtgaactctcttccgggcaacaccaacgtgttggtgctccaggcgaaaccgaactctgtttcgattacgccgtcccgagaagccctgtccatggaagagcacaccaggaagaccctgatcgaactgctcaccaagttcctgcgcacctcgaagtccatcaaaaaggagcgtaaagatctcctgttcaagtcctgcgacgaactggttcaggtagcccagggtaagatggtggtaccgatcgaggtaggggtaaacaacgttctggttacctctcgtcgtgacggaagctggcggcgtaaaagcctcatgatgaccatgcaggatgtgggctacagccagttgtcggatgcccacaagcggagtgagaaggagcacttcaagaccctgctgaagcaattgtcgctgatcggcaagcagccgaggaaccagggtaataccctgtacacctcgttcatccggctggtcaagaaggtcggaatctctgtgagctactcccactacgagcgcagttccttcgaggacttgctcaagttcccgaaggactcctggcaggccctggaagtacgtaagtggggccagaaacacttggtttccaagctgcttccgctgatcaccgaagagggtctgtgccctactcgtctgatctggtacggggctggtcgtaacctgcacaacggcgacgctgtacgcagctacaacagccatcaagggttccccttgaatcggtactggtcgaagaatccgatgtcctacgtaccgctgttccgccgctgcatcgtactgactcacagccgtcgtgatatccatgatcgtgttcaggaccacgatgactgggtaggcggttaccgtgctgacgacgccctcatcgcttacgtggttccgcgtagcgagaagaaggtggcagaagccaggaaagctctgtccactctgtccgggtggcaggtcatcgacctgactcaggaaatggagaagctgagccgggaagaattctattcgcccagtgttgtcactactcctgccaagccaaagaaaaagggttataccatgctctcggcctgtcatgtcggagggatcttctctctggagatggcccgaaaggatgacgtggctcgggtggagaaccctgctttcttcgtgcggctgaacgccaagagcgactactacgtccgtcggtgtgtccgtggtttggacaagttctgttctgctttcctcctggagaagtacggcgacctcggtgcggtggtctacaccgaaacccaggaagccaacatggagaagaagggcatcaagagcgccaaggacttcctcctgagcaagttcgaggaagccatggacaagcctgagttcattcaggtttgctctgtgcgtactggagtcctccttaaggcggtaaatgacatcgacgccgtggacttcgtggaccggatcttgaaagtcgaagcatgccgtaaggcattcaatcttcccgaccggtgggcacgaacccacgaggcagagggattgctcaatgtcatccagaacctcgacccccattggctgaaccatggacagcgggagatcctgggcaagatcggtgccaagatctcggctgttcctgccgacaagaaggtagtggcactggcgaagaagatctccgaggctcccctgttcaagctgctgaacatcagcgaagtacgggttgccctgggtgataagaagaccgtggattccacgatcaaactactgaaaacagctattcgtggctgaaggagaaaccaatgagcaacaaagtaactgtcgtaggcgctgtcctcgacgagcggtatctgacgttgtacgtgaaagggtctgccgagcagatccgtatccctcaaggcgatccccgtgtcgccgtcttcgtcgagaagtacgtccccatcctgagccagggtggtgaagtggactactccgaagacctgctggtcatcaacaacgtctacaaagccgccgagaagaagtccggtggcatcatgcggttcttccgcgtggcgaagaagaaggtcgcagagttcttctcggcggtttccgcatccgagccggctgctcccgtcgctcccgtcaccgctggcgcggttcctggcgactgcgcaccggacacggatgctggtcaaggggaggttggtgaagccgagaaggtcaccatcaaagaccccgtactggccaaggctgtggatgacatcctggcccatgccgtaccgtccactgcccctaagttctcttcttccgacctggagagcctctccgacgaaggcgtagaagacgaggacgaggatgaagtccagggcgacaccatcatcgccgtgaccgaccagggaaccatcgtaccggacgcccacaagctcaagacccagctgaccgcagctgtacagtcgaaagccaagggcagcactgtcggcatcgagaacttccttcgccgggccggtgccgtatctgtcaagcgtagtcacagcgtgcaggatctgatgcgcttcatcgaacgtggggatctccccatcgccgatgatggctgcatcgtgatctacaagctgctgttgaaaggcggcccggacggtcacaaggagttctcttaccgtgacatccactcgcagaaggtaccgcaagccgtcggcactctggtgtgcatgaacgagtccctcgtggacccggatcgccgcaacgagtgctcgaatggcttgcatgtggctcgccgtcagtatctgggtagcttcagcggcaacgtgtgcgtgctggccaaggtggcaccggaagacgtgatcgccgttccgtcctacgacgcgaacaagatgcgtgtccgtgcctaccacatcctcttcgaactgccggacgaagccatggtggccctgaaatccaaccgcagtatgaccgacatcaaggaagcctcccgcatgctgggggctgctctggcaggtcagcacagcgaaccggtttaccatgtggagatcaccggtcactgtggctccagcatcgtggtgcacaagggtccggcgagcaccaagaacaaggtgcagacggctgttccgaagaacgctcctgaagcccgctcgcttccgactactcccagcgaagtcgtcggcgagaaggtagacgtgctggctgtagtggataccgtcatgacggaaaccaagcagccggaaccggaagctccgtcgctgaccaaggacgtgccggtcgctgagccgaagcccgccaaggtcaaggccgagaagaagtcgaagagccgtgtaccggctcgtaaggcgaagaagctgaagtcggacaaggtggaagccaaggccgtagttcagcccactcgtgacaccttcaaggccaagggtgaacccctgccggctgataagaagactgccatgaccctgcccgaacaaggcaaggccctctgggatgccttcgtagccagcaagggcgacaaggccaaggctcaagcctgcctcgacttcaagaagtccaagaagaagggctgggctgtgctgggtatgccggaagacgcggctgaaaagctggcgaaagccatcaagtaactaggtacgggggaggcaactccccctatcctttagtctaaaggaggcaccatggactactacattctctacctggcttcaggtgtgacctgtttcttcctagctatggggggaacttacaagctgccacctgccgctctgttacaacgcatgttaacaccgtcctgggtagtatccctaggcttcttcctcgccttcatgttccacctgttcctgtggcctgttggtgtcatcgccagcatttggctacggatgcgcaagaagtcaactacctgatggatacccgtgtgttccagtaaggattgctttatcatggcaactggctgctatacggccttgaactttgctggagagtaccaatgccttggaaaagcgacccgaacatatggggggtgctgagtgcgattgcgctcagtgtattgagtggggtgatcagcctcacttcacggattgcaaagggacacccacctaaatttgtgtggattgtctccgagctatcctcagcgatcctcgtcggctacctgatctacgacgtgtatcccgtgatccaacatctgctctacgagtggatgaccatgccaatctgcattgcagttggtggccacctgggaggtcgagtcttccagtgggttgagttcaagtacaaggagaaattcggcatcccggactcctactaaaccaaccagaaacccgcttaggcgggttttttattgcctggaggaaaccatggctgaagtaatcaccaccgttttggaacttcccaacaccgtcattgcttcggctgtcggtgacaaggtgctggaagctgatgcgtaccggcactacctggagtcgatcaacgttgatcctcagttcgtgctcgacgagtacatagcaatggtcgaagagaaagaccgggaggtatggaagaatgtctaagtacgcacccgtattcgacagtgccaaggtagcccggttctaccatgtgcgtgcagttgctgatagcaacagaaggcaggtcagattcttcaagactacctgggttggcttccttgaaactgacagagcctactgggtagtagatgaagatgatctcaaagaactggagcatattgcgagtattcgtaagataactgctaccagtgatattcgtgatctcgctaaggagagctacggtgctttcctcgcactgaaagacggtagcaccaagcgagcacgaacctctgtgaaagctgctttccacagcatgatctgccgtcgtgaacgccagctggacatactggaacgtgacctcaacagtgctcaggcaatcctgttgggtacccgcctggataccaaggcagccgagcggttggagatgctgaacaccaccacagtggagatccccagttcctgggacatcgatcagcagatcctcaccgagcacaagcgtatccacgagaacgagggacacgaagaaggtgcactggtctgggaacctgatttctgacaggcattaaaaaacccccgaagacctcagtctaagggggttacgcatggtgtcgaaggagactactggggaggagcgtgccccagtgacttcacaatagcgtagctcttctggcatgtcaatcctgccgcatggcttcggtcaagcgctcctgcgagttcttgtcgatggctgacacagcttccgtacaggtcggcgagcaccacagaggcagcgttgcttgcatgccgctcagtggtagctctggcaccgtcggcgatgaggtcgtcacgtagacgggagacttgctcccgcaggctacgagactgagcatcagcagcagcaatgcgggcagcttgatcagccagttgttcatcagcatctttttttacctcgttcatggcttcgagcagactctgttcgatggcctttttgttttcttccgcagccctttcggcctgcatcatgcggagttcccactccgcattggtttttgattccgccttcacgaaccccttgttgtaggcgtagagggcgatgatggcgaagagcagcacctctgctatccaccggatctgacgggctgagatggtcattgggtcaccacccttaccgccttgcgatacagttccggccaggtagcttcatggggttgcccaggacgccactggcgtatgtagagatcccatgcctcctgctgagccttgataggcggcagacggtgagggtccgtgtagagcaggatgcgagccaaggcacaagccaagacatcatcatgctccagggcatcccacacagcgtcttcagttaccggcacacccctggccttgcacaccgagtgtaccagttccttggtggctggcttccagaagttgagcagtcccttgacggcaccgcccttctccatctgccagtagcccttggctgggccaaggggaagaaggactttacgcccctcgctgttgatggagttcaccagctgcctacgagaggcaaagcgggactcctgtaacccaatggccagcagcatgacgctggcctcgggactgttcatgctggccggaagcagcttgtaggcttccggtagcacctgattgaatacctgatccgcagtcatttcggttcctccggtagaggatagcgttcctgtatttcctggactttctcaagccaaggagtcaggtcagctacctgcccttcctccatcgccttggcttccagttcgatccgaatcggctcgctctcctgctgatacgcctgcgcccgaaggttcttcgttaccttcagggcttcctgatacttcgacattgccagatccttcgggttctggaagtcgtcccaagcgatagaagtcaaagggcatctccacgggaccgtcctcggtcaccaaaaaaggttcaatgatcgactcttgagcatcaaagatctccagagtcacttgatgaatataccggatgaagaggtttccgtcttcatagaggatttcctggaaaggagtacggcctatataggcttgcggagggaggaaacctcccccaatgaagggggagaagtcatgttccacaccatccacagtgagcttggtgccggaaaccgacacctcgcttactcgttccctccctgggacatccacttgcatatccggcttgaggatgaatttcattatttccaccgtcctattgctactacagagcagttgatgaaggagttgctggcaaaactggtatcagtataaccagcaacgcggaagcactgtatcagaacattcccattcgccacgttatacgtgaatggtcccataaccgcagagatgggcattccgttgatttccgctccaggaccttcaatgggctgcacgatcaaagcgggaggttcgataaagcccatcggataggtgtacatgtagttcagaataccttcggaggcgaaggtaagccgaacagtagcagagacaatctgcgtaccgttggccaagcgtaccgaccgacctacgttgaggctgttgttaccgttgctctggaatacagcagaggtaagcaagtcgttggttacgctaccttccagctggttagaagccagaaggcgtacccaactttcccacccattgttagatcgagcacggtagaacacagaagtggggtaagcccctacaccagcagtacgggggaacagcagctggtacttcgtggcattgtcgaacaccgaggtgatcgccgtgtgcccgttggttccttccatacctagaggcaagccagaggttccattgggcaccgcgtagaagccattactggctgtgttgtcgatgctgttgctgggaagagcctggtttgcgatgggcatgccaccgatatagttgagcgcaccacctgccgaagctgcacccagcagagccacaccagtaggagtggcagagaggttacgccagccaccatccgcactgtcctggatcggtacgaagccagacatagtggggctaccaggcgggttgaacaccggcagctccatgaacttcagagttcgtggcttggtgacgttgttcgcatccaaccaagtgaaggtggccagttctaccggagtctgccagacaccagaagcattcgtcgtacggatgaacagtcggccagagtaggtcggattccacagctgccatcccttgttggtgtcataggacttgtggtctacgaaagccggagcattgcccagaccaccaggaagggggttacccgaaccagcaggaacatggtagtagccgctacgaacacctggaccagacatctgagtgccagtccggctacccatggtcaattcaccatatccataccggctggtccaatcctggaggaaggtgaccacatactcggtgttggcgatggtcttgccgaacggcaggagaggagtttgcgtaggaacagtcggaataccagtgaaggtgggactatccaaaggagcgaaaccattggtatcactggagttggagaagaactggcccagcttggcggcgatcttctgagcagaagcatccgtcaggtgcaaaccgtcatcagcagcaagggcagggtccatatacccgtccttggtgagaagacgtgcaatgtccagggtctgggccaaaccgttgaccttgggaagttcggtgctccaccacgtatcggtgtagtcacgaagcttgaccgcaccagtagaagcatcgttgtacgccttggtcccctgcatcgagttgaacaagactacctgagcaccgacagaatgaagctggtctacgatggcttgggtatccgaggtccgcttggcctgggtcatggttgcatcgttcacgtcattcgtgctggcgtgcatgaagactaccttgacaccggaaccactgatctcactcagttggctcaggtactgccaggtacgacggccttccacaccctgtaccagaaccaggttgttccggttcgtggcgtacagcggaaccttggcaaaccaagtaccggcccagttacggcggttgtggtagtcctcagtaccacgagtgacaccgtactcgttctggccagcagcgatgctgtcgccgtagcagatcaggttaggcttacacaccgagatatagtcaaggtgcagccaccaatctttcggggaaacagggaacgaggatacttcgatagccaccggcttgagagcacccaccatgaggcgaccttcgcctttttcccaggtggaattgggaaggcgacggaagagttcaacatgacggttgactgcatcgtacttgatggccagatccatccaaagctcagtgttcaccggagagaacatgctggctacagtgcggtcactggcaccttcatagccatactgcatggtgatcacacccggagtaggaacgttatccgtaccgaggttgaagtagagagagcactctttgttgtcttcttccatgagacggatttgagcacaccggttctggcccggcaggccgttctgcgtacggatacgcaagtagacgatccaatgaccatcggggaattcagcatctttacgcaggaaagcccgagaattgctcccatcagttttggccacaaagagaacgccatcatcagaggatcgccagatgggaccagaggattcccacatgtaagggtcagtgccctcgtaggtgaaggtttcgttcatacccaccagaggcgggagagagccaccctctactttctccgctacaccatccgccaattcccgagcacggtcagcttcgctcttagagcggtccgcttccgtcttggaacgatcagcttcgttcttggcttgggcagcagaggcagccgcagcagtagcttgagtggtggaacgatcagcttctgccttggaacggtcagcctgggcggtagccttggtgacttcttctttggccaaaccaacctgctcagttgccttggttacctcggctttggccaaaccaacctgctcagttgccttggttacctcggctttggcgagatccacttgatccttcgccagttccacttgctcggcagccagacctacctgagcctctgcacggacagcagactcttcggcatcgtctcgtgcattgcgagcatcgaccactgcttgggagatcttgttcatggcttcctcgtcccacggcaagttgttgggaggaggcatcaggatcagttcttgtacgtagatcgggtcatccgatacaggtacgtagaaggtgaaggtgaaggtgtactgcgagcaggggtcatcctcgtactcgtcatcaccgcctacagcagtgactcggtaggcggaggtagccgcttccaggtccatggtgaactcgccgttggagtcagtcaccatctcataggtttcggggataacgacgcagtgctctacgtcgctcatgcccggacgagtgagacgcacggtgaacttttcgttcgcctgtgggctgccgtccgggctatggaaggtgaagatcaccttggtagtcatgggaatatcctcttcgaagggaacgtgcagtgtaccgtttattcgatggccaacaaagcgtggtcaatggtatttctgggcctgtttccagcaacaaaggcagcgataaacatccatcctgttggaccgttcagcatgcctatggtcattcctttatagcggaaagtggtattcccatagtccacacggaaatacgctccctgcctgatcagagtagcgtccgcccaccaacttgctagtgaccgtcctccagggaagttggggttccatccgtatgggtagaagcgttggatggcaccgaggaatactgctggtttgtaaccagtatcgaataccccgttaccttcaccgtcgaatacctgcaaaccccatccggcagttttaggcatgtggatggcaacaatcttgtactttcctgagtacactgatggggccatgcccgcaaagttggtcagaacgaatcggcagcctgtccagttaccattcgtcccaaaccacaggaaatccgtgaatccatgtggtccatcttgcttggcgaagaagatcggcaagctttgtgacctgattggggtagggaactgaatgtaaataaactcctgtcctattcgttcgtatcgataagtaccctcctgtactactacgtagacaggattcatctcgtcaatgcagatgtcgttattgtcgttgataagtttgataccgtaggtcatttgaagctcactatgttcaggtaggcccgaccgtagtcagggttaaaatcgtctgcccagcggatctcgttattaatgaatgcgaagtccacaaagcgaggccatgggttgggattcagatgaaaccaggtaaggaagaagaagtccgtattcgggtcaaaacctgggggcataggggtattcgccccatacagagaggggaatacctgttgccggtagacagaccggaaggacttattggtcgagtctatagtgacgttaccgtcagcatcgtaaaagcggaatccatagctcatgcttgcaagttcccaatgtgcacccggagtttgcctgcttggtcaaacaccttgatggtggcgttgttgatagtcatacggccagtaccagccgtaccgttgatttccatgatcccgttgggacggaagacccagccttgggttcccggttggtagttgtccgattggatgttgttcaccacgatatccttggcttcgatgtagtcagcctggatcttcccgttctgaacaatgaagctgccatcctgtgccctgagcttgtcgaaggtcaacttctggatggcagcttccttgatgtagacgatgttgttgtcgatgatgaacgggtagcttcccggactcttcggagtaccaggacgaccgatccagaagcggtctacgttgaagccagcttcaacagtgttaccgtcgttgtagacaccgaagccaccgaccaaaccattcacatcaacagtggcagtccagcgagcaccgatctgggtaaccttaccgtccagagtctgaacctctgcaaccaagccaaccttaccagaggcagagtccccattgacggtggcgttgatcgtggtcaccgtagaagccagggagttaaccctggtagacagtgcgatgttctcttgttggattgctgcgatgttcccattgaagtccgagtacatggtgttgaccgtctgaactagagaactgtcagcagtcacacgagcacgaacctcttcctgcaagatggcagtattctgatccatcttggcgtcgatctgagtgagacgaacaccgagagcatcatcgttcttggctcgttcaatctcttcctgggtgatacccagcttgttcagttcgatctgggcgatctcttgccgaagttcttgtgacaagagtccgttatcgatctcaccagtcagctgctcaatcatctgctcgatgagtggacgtgcagttgctgatgcaggaccaatgatgtccccatcagtaccgttgatcgaaaccaactgaatccagtagtagtaccgctgatctaccttagagcctgggtccgtcttgtcgaagtagaagttaccactgacgaaggcacggatagttgcacctgcgaagtcaggggaagtactacggaacagtcgagtagtgcccactgcacctgggttggtagtaggccaagtgaactcgatgtcgatacccccgaaggcaggagttgccttcaggagtaggtcactcatgttggggtcacctggcttaggaccgttccagtccccagttccacagacccccgtgatgttgcaagtgtcaaccatgttggttcctccagagttggtcaaagtataacctccctaacctcccccagcctatccacgcaggaacgcagtccgccgaggatcgagcgaagcgagcaccgcagagcgagacgggagtggatgcgtggataggcggaaggaaataattgaatattcaatttcttccggtcagggatcaggttacgggtcatcccttgcgggcctcgctgcgctcgctcctcgggcgaccacttcacctgatcccttccctgaatggagaagggggagggtgagcgctagtggtcgccctgggacggccccttccaggggcgaaccccttcgaaagaagaggggtgagagtcccctattatatataagacactttcgtgatcattttttaaccaggaggttttcatggaaaaactcaccgctgcggacgtacctttcaaggacttccccatcgactccatgccgaacctcctggctcagctgggcaaggctcgtgctgacaccatccggtttcatggcttggatcgaagatcgataggaggaccacggactcgttggtttaccaacccccacgcaaaacgcttgcaggggcttcctgatgcgttttcggatcgaggggtagaggacatcctctcgggcatcgcatcagccacagagggctcccagaggccgttgtcggctgcacgtctgttcgtcctgctacaagaacctcagctgtgctacgacctgctcatgggtggcatggctttggagaagcgacaagcgcttcgctacatggcagcagccaagctagccgtgttccacctcaaccgatactttggagcaagccaatgagagatccacgatactcgcctcaccccgtgtgtaaggcacagcatccacagggacaaccctgtgaagactgcgagaagcttcaccacaggttgccggtcaaggcttatgtgaaagcacctgctgatcaacgggcggaagcaaccacgaaccgataccagcgggtgatccccgacaactggaaatacctggacgtgtaccggatcaatatgctgttcccgctgggcgacatcgaccactccggtgctctggaccatgcccgtaagaagctcatggcaccaggccaacgtagcggcggcaagagcgtctggcaggacgttaaggaagccagggataccctcaaccgttggcttgaagacaacgcaggggaggaagcctgacatgggccagatatacaccaaccagacgggtattccgatggctttggctttgtggctggcttcggactactacgactacagcgaagcagggttgtcggccaccaccttgctgaaaccaatcaggcaagtggtgctcgctcgtcggatcaagccatccgattccatggccgatatcgagggtatgatcgccaaccgcatgggtgcagcgatccatgactccatcgagaaggcctggaccgtgaacaaggaccgggcactggatgcactgggtatccccgcaagcgttgcgaagcgtgtgctggtgaaccccaccgaagcagaactcaaggctttcaacgaagccaatgagcaacctgccatcccggtcttcatggaacagcggtccaagaaagagtacgcaggagtagtagtctccggcaagtacgacttcgtagcagatggtcaggtagaagacttcaagtccaccaccacctacagctacatcaaggactcgaaggacagcgactacatcctgcaagggtcgatctaccgtgctctcaatcccaaactgatcaccaaggacaccatgcgaatccacttcatcttcacggattggcagaagttcatggcgaagcagaacaaggactatcctcagagccgcgtggcttcgaaggtgttcaacctgattcccatcgccgaaacggaagaatggatcaccaatcgggtgaagctcttgatgtccctcaaggacaccccggaagctgatcttcccttgtgtaacgacgaagagctatggcgaagcgaggcggtgtacaagtactatcgtgaccccgccaaggctgaacagaagggtgcacgtagcaccaagaacttcgacagcctttcggaagccatggctcaccgtgccaaggacgggaacgttggtgtagtgaagaccatccccggacaagtcaaggcttgcctctactgccctgcatacctgctgtgtactcagaaggacatgctcattgccaagggcgaactcatcgtataaacctggagtaagtgatgctcaagtacgaggaaatgcaacaccacccgacctcggaacgcatcgtcgaaattctgtgcgagaagacccaatccaagaaccacaggttcttcaggatcttggttggcttccagttctcgatgatggcagcgcacatgcgttgccacatcaagactcacgaacgcggcgagattccggtcaacatgtacgccctcaacctgatgccgtctggcgcaggtaagggcttctccaccaaggtgatggaggaccagattaccgtgggcttccgccatcggttcatggaaaccttcgacaccgcagccgagaaacacctcgacgatctggcgttcaagcgccacatccgaaagggttctgaactgcccgacgaacaggaagctgtccgtaaggagttcaagtctctcggccccctgctgtacgacttcgactcgggtacgggtccagccgtcaagcagatgcgtcacaagctgctcatggccaatgccggtgccgtcaacctcgtggtagacgagatcggcctcaacctgcctgccatgaccgagatcatgccgacgttcctggaactgttcgacgtgggttcggtcaagcagaagttggtcaagaacaccaacgacaaccttcgcggcgaagagatcatcggtcgtacgcctaccaacctcatggctttcggtactcccggtaagctgttggatggtggcaagaccgaggaccagcttatggagttgctggagactggctatgcccgtcgatgcttcttcggcatggctggtgaaggcaagaaggtggacatgaccccggaagaggtctacgacctcatgacgaagaattccacctctaccttcatcgaagatctctgcgacgatctggagcgtctggctgacgcgagcaacatgcgtcgtgtgctcaccatggacaaggacaccgctctgctgtccatcgagtacaaactccgctgtgagcgtatcgcggcggatctgccggagcaccaggaagccaagaaagccgaggttacccaccggtacttcaaggctctcaagctggctggtgcctatgccttcgtggatgattcgcctgtcctgaccatggaccacctctatgcggccatcaaggttgccgaggaatccggcgaatgcttcgacatgctcatgaccagggaccgtccctacgtcaagctggcgaagtaccttgcagccaccaatgcggaaaccactgtcgctgaactggacgaggatctaccgttttatcggggttctcgccagcagaaggacgacatgctggtgatggctactgcctggggctacaagaacaacatcatcatcaagaagacctacgagcaggacatcatgttcctccgtggggaagcactccaagccactgacatacatgaaaagagcctgatcgtggcctactcgcaggacatcgcgtacggctacttcaacgacatggctacctgggatgacctgtggaagatgacccaagccaatggaatccattggatcaatcaccacctcaatggtggcgaggaacgcaagggccatcgcaatgaagagaactgtaaggttggtttcaacctgctggtgatcgacattgaccatgggtgcaagatgtccacggccaaggaattcctgaagggctacaaggctcttctgtacaccacgaaacgccatcaggtggacgacaatggtgatcgcttccgcatcatcattccgttgaactacaccctcaagatggacgccaaggagtacaaggagttctacaacgcggtgatcgaatccttgccgttcgaggtagacgatgccgtaggtcagcgtgctcgcaagtggctctctcatgggggcagctacgagtatctggatggtgaactgttcgatgctctgccgttcattccgaagaccaccaaggacgaggaacgtcggcgtacgctgaaggaccaggcatccatggacaagctggaacgttgggtgatcaacaacaccggcgacggcaacaggaacaacatgttgctccgctacgccatgatcctcttggatgctggcttcaacgtgaacgccatccacggcaaggtcaacgaactcaactcgaagatggccgacaagctgtccgagatcgagatcgcctcgaccatcatggtttctgtcgccaagaaggcaggggccaacggcaattgagcttaggggtgcctccggcaccctttcgcttccaacatggagtcaatcatgacgcaagtgaatgaccatctggtattggtttccgggttgtccgctaccggcaagtctgcctgtctgcggaacctgcggaatcccgaaggtgtgatctacctaaactgtgaagcaggcaagcgattgcccttcaagtctaagttcatcgagcgtacggtaaccgatccgtaccagatcccatcggcattcgatgccgtgatcgagggcaaggtagatgcccacaccatcgtaatcgacaccctcacctatctcctggacatgtacgaatcccagtacatctaccgggcggccaacggccaagctgcatggatggacttccagcagtacttcaaggatctgatgcagcagaaggttgccggcagtccttgcaaggtgatcttcttggctcacaccaaggaagagtacaacaaggcaaccatggccatggacgtgtgcgttccggtcaagggtgccctgaagaacaacggcattgagtcctacttctccacggtgatctccaccaagaagatagaactcgggaagctggagccgttcaaggagaacaacaagctcttggagatcacgccgcaggaggaaatgcttggctacaagcacgtcttccagacgcagatcaccaaggaaactgtcggtgaacgcattcgtggtcccatgggcatgtggacgcacgagcagacctacatcgacaacgacatccagaaggttctcgaccatctggactggtactacaactgattcacgcaccgaaaggaaacagcactatgttcggtaacctcagcaccagcaacaacagcgacgtacaagaagccaaggatacccttggcggcggcagtcgcatcttcgacaccgacatctacgccttcaagatcctggccgcctatggttcggaatcctccaagggcgccctggccgtgaacttcgagttcgaagagcatggcaccggccgtaaactgaaggttcagcagtatgtgaccagcggcaaggaaaaaggccaggtcaactactacgtcaacgacaagggcgagaagcactacctgccgggcttcaacatcgtcaacgccatctgcctcatgaccgccgaaaaagaactggcggcctgtgcaccggaacagcgcaccctgaagatctacgactacgacgccaaggccgaagtacccaagcaggttccggttctcaccgacctgaccggcaaggacatctacctggccctggagaagatcatcgagaacaagcgcgtcaagaacgaagccaccggccagtacgaagattcgtcggaaacccgcgaatccaacgacgtggcggcggtcttccacttcggcaccaagaagaccctgaacgaagcccgtgccaaggctgatcccgagttcttcgacaagtggaaagaagccaaggccggtaccgtacgcgacaagaccaacaagaacgcaggcggcggcagcaactccggtcgtccggccccggctggtggtggtcaagcaggcggtggcaagcccgcaagtctgttcagctaagccatgaaggtccgggaactgctcgattcgttggagcggcagttgagctactgcacgaacccgcaacaacgcgaacggttgctggaccacaccttacgcatccctgtgctccgccccggtactgtcggggcgaggccatccgtggatgtgataagtgtggttcctggcttcgattgggatgacggttcgatgttctgtgaacccaactccgacatcaagctcaccgtactgacccccgaagaagtgaagaccatcaaggagagctacagcaaggggacatcttggtttgcctaccaggaaaccaagaagctacgggaagagatcacccggctgaagaagcagctggagctactgggaggtagcgaatgaaagtcaacccgcaagacgtgaagaacatgatcgtgggggaaacctacacggttctacccaacggtctgaccaccgtgtgccagcttaccctgagcaatgggtggacggtcacaggtcaatcctcctgtgtggaccccgcagagttcgacgctgagatgggtaaagaaattgcccgtcgtaacgctgaggacgaggtgtggaagttcgccggctatgaactgatgcagaagatccaccagctgcggttgctcccgaaggagcggctgaaactggaactgatggagcttcgtgatcgtcaggcccgcctgtctcagtttctgcgtcgtgacacagctgtagacatcccggaatacgcctacagcctcctggaacagcaggaaaccgttcagcagaatctcatcgagatcctggaagaacggctgaagcaatggcaaagctgaacgtaatcggcatggaccccagcatgagcaactggggtctagcctgcggtcagtttgacacaacctccaacaccctcagcctcaagtacatcgaggtagtgcagacctctaagtcccaggacaagaagatccgagtcaacagcgatgacttgaatcggtccacggagatcaccgccagagttctggaagtgatcaaggaagcacaggcaatcttcgtggaagtgccagtaggttcacagtcagccgcagccatgaaaagctacggcatgtgcattgggattctctccgcgattcgggcaagcggtaagcccttccacctgctcacacccactgacctgaaggtcatggcttgtcgttcgaagacagcttcgaaggcggacatgatccagtgggcagtacaaaagtacccccatctcaactggccccgtaacaccaagggcgaggtgatagcatccaaggctgagcacatggcagatgcctgtgccgctgcggagtacggggtattccatcacaatgatttcaagctggctttggccatgctctcttaaaaaggaaccaagatgaaaatagaactacaacaagctgaagtagccgccggcatcgccacctacctgaccgccaacggcctgaaagccgaagcttctcaactgtcgatcaccttccagaccacccgtaagggcgacggcggcatcgtggctttcgtcgaagtacccgaactggccgttgccagcctggtcggcaccaaggctccggtcgcttccgagccggaagtcgtcgaggtggtcgagaagccgaagaaggccgacaagaaggtcgtcaacaccgaagctaccgcgaagctggccgaagccatcgtcgaaaccaaggcagccgaaccggtagccgtggccgaagagcctgcggtcgaggtggaagctgccactgcggtagaagtcgcggaagaaccggaagccgctcaagctgctccggcgagcactggtggtagcctcttcagctaacacctcttccatgcgccgatagcccccgtaacagggggctgtctctaccggagtaaaccatgaaacccaagtcgtactacctcctgtccttcgccgctcctactggcgtaggcactgtattccagtcggctatccatgccttcgaacaaggcagtagccatgacttcaccgtacccctgatcgctcagatcaaagagcgtagcggtatcggtgccaactcgatcatgctcagcgtatccttcctggggtccatgaccgaagcagagttcaatcccccgttccgtcctggaatggatgccacagtcgcttacctcgaaggtgtgcgtgctggcttggagaactccgagaaagacaacccgtaccccactggttcggtcgaagcagcagactaccgtaacggtcgtatctctggcttcagcatgcgtgaaggtcagcaacctccgcaggaccatagtccgcagtaaaaagagtattcccttttgtccgctgatacgttactaccttcattccttttctgaagttctcgtaatggttacgggtaggcggactctttttagtgttgactgccatgtcagcctcctgtaagttgagaaccatgaagtggagacaacctcttaccacctcatcggcccctggataccactaccaagtcccccttgtccccatagatccaaggggccgtttaccacctcccttaactgatgccactgtagaccaagccagctaccccagctggctttcttatgtctattgaaccagtaggcataagggagtgctctggcccgttgcaacgggtacacccaccaccccgcaatggggtccagaccagagcactccatcccttacacccaaccagaaggaatttcgccatgggcgatttgagcaaagcgtgcatgctgaaaaacatgcacgtcacacgtgtgctacacctcatcgaaatgcgcaacaagctgacgaacaccttacgggacaatgccaccgacgacggtatggctaccctggagatgttcgacgctgccctgaagcaggaaaccgaccgcttcctccgtgccttccgtgcagtcggcaacgagaacatcgccgcgaccaagaaggtagcgcaatgagcttggtagatgcggtagtagaagccaagcgccagggcgtacagcacagcctccgtgacagcaattacgagtccgacatcccgccgagcctgaaggctctcctggatgaagccctgcgactggccaacgagcacagcatcccgctgtactggtctgccagcttgcccaacggtgtgatgactcgcgctgctctcggcgagaagggcgagaacatccacatccagtacctcatgtcctatgcggctgcggtacaagatcctgccctggcacaagaagttgtgcagaaaggtatggccttcctcgacaagaagtaaggagtccgtatgggagtcctgaaaggattgttcggcgctggagcactagcaggagccgtgataggcattctgttcattggcttcgtattcagctggatctttagaatactcggcgtggtagtagcactgttcatcgtgctactcatcctctgctgggtaggatgggaatggttgaagtattgcttcagcaggaagaaggagggggagcaatagctccccctttcttcattacaggttcataagacctttgatacccggtagttcgctcaagctggatggccaggaccacggaccagactggaacgggttgtgcccaatccggttgatccaagagctatccattaccgactgcaagccactcacaaagtagttggcagcaaccagagccagtgcacgagcaggcttctgacggatcaagcgagcgatcaccttctgcacacgcagatagtacttggtgaacatcaccagacccatgtcgttcatgaactgaagaccacgtccagaaggcaagtcatagttgatgaacgattcttcagcctgacgcagagcatcagctttactcagtggatctttcgcacgagtagtcaggtgctcatacagtgcatagcgagccacaaggtcactcagctgagtggtttggcttaggaacttgtacgcagcagtgtcgtgagccatgtagacctgacgaccaatgtcacgtaccagcttcggcagcttgctggtgtacttctcagtcttcttctgtagcaaagacttgtagctgtactgcgagtcatcagcttccacatcttctacgatggttggcatcagtccggcatctaccagcggcttgatcgggttacgattcaagcgatccatcagcacagcgatctcatcacgtacagcttgctcaccggaaggcaggtaaccaacatccagggcacgttgaagctgaataagcttcttgttgtcctgacgatactggagagcagccttgataccggtagcgtgagcgcgtacaccctcagccaagccaacaccttcccaagccaacagagtcatgttcgagacaatgttgcctacgagagtggtgatgttcttgattaccaggatgtccttggcttcacggaccagttcctgcatcacatcctcagcacgaccaatgcgaagtgctgccttctcacccaggatggcttcagcaacacgtacaagcaccttctcggcgatgttgcgttcgtcttctgccaagccaaacggagtagtcaggctgtacttgcggtaacccatgatcatgttcagctgatcagcagggatctgcatgttgtcactaccccaagtcttacggatctcacgcttagtggtttccggcagcagttggtacaactcaagcagttgtggatcagtgctgtccttgcctactaccaagtagctgctgggacggttggcgtaatcctcgcggaattggtcgtacatagcacgaacaacgtcagcgttctggattgcggagtcaaccttgtctacgatctgacctgcaagagtacccagcacctgttccatggagttgtcacgatccaggagactgtcacggttgtgttcagtcatggtgtagcggtaatccacgatagctccgttggggttaaccacaggagacacacgaccaggcttctgctgacggggatcgtagctacgatcacgcaggaacatgtcactcacatcttgtgcaatgttgtgcttgatggtggtgatggcgttcttcgcagtacccggagccgaggacagcatgttggtggcttgacggtctaccttggtaccccgagcgtgcacaccggtatagctcattgcaccagtcagcaagccaacctgaccactaccacgacgggtcactagaaccttgtcggattccaggccagcacgctggtctacctgcacgtcaccagcaacagcgtagccacgcttctggaagtagggcaggtcactacggtctacggccaggacttcgatcttggagtcgaagatgtccggtacgtagccatcggtgtacagacgctcggtgccttggaacagggcatccttggagcgcttacccaagccatggtgcatggccaggatcagatccacaccgttgccatcggtacggttggattcggtcttcagcacttcacgggcacggctcttcacctgggaaccagagtactcccacccatagacagcttgcagctgatccagcagttcgatggctttcgcacggtctgccttggacgactgaagcactcgcttggtacccagcatatcagcgatgttttcgctgttcagcatcaggttcgggctgacgttaccgccgatcactcgatggtaagccagatccttcacagcacccaggaagtactgtccattgggcagtgccagcaactggtcttcgaggtctttgcggagattggcgaactcgccattgtccagaaggacttccttcaaccgatccatacccagtgcttcacgcaggttacccatgttggtacgcaggaagcccttggtgagtgcagcacgatcttcagtgctcaggtacgaaccgttgtccttgaacccctcgttgatcatggcagccgtgtactcgatgtgctgcttacgagcaatctcgttggacttggcttgcttgaacagagtgtgggcagcgaggttaccctcgtgagcaccacgcatctcattcactacctgcatggccatgccgtgctggctcttgaaggcgttgtcacggatgcgagtgataccgtccaggaccaagccaacacgctcattggtgatggtgctgatggtcttaccagctacccgaacaaaggggctgctcgactgagtgaagaaggtcgattcagcgatccggttcaggttgtctttgatggcttcaccagtgttcgccagggcagtttccacctggtccagggcacccactttctggtcagccagacggccacgacgcttggcttcgatatccaccagacgatccaccagagtgaacaggcggctctcagccacctcacctggacgagtcttgtcgtgcagctgacccaggcgagtaagcagacgacggaacatctcaaccagacgagtagccagaggcataccggacagggacttctcgctgctacgggtggtgaactgaagcaggttcgctacttcctggctcgctacacccagggcagcaaagcggctcaggtagtcactacgggaacccacacgctcaggacggaacaggaagttgtacttctcctgtgccacatccttctctgcttgagtggcttggtcccactcaccagcgaagaagtccttcgcagtcaggcgatccttggcttcacgccagaggttctccaggctgctgcggatgaagattccatcgttgctgttcagagtggtggccacagtagcctcaacctgctccagcacgtaggcttcctgcgggctgacaatgaacgccgaagccaatgcctgagaggcgaagggcaggcggccagtgtccagagccttcaggacggcatcagtggtggtcagtgcttggccacgggcaacctcgttgcggaatgcacccatggggccgtaaagctcggtgacgatgctgttcaggacagacttcagcttgttgctgtgagcctcggtaagcggggtcttctcgctttccagggcattgaagatctgctcactgctcatagcattgacctgatctacagcgtcctcgtacttcagggtcagatcgctacgcttggccatctgtgcagcagcctcagcgaacaagccagaggtattgctgatcaccaaagccatggcattggtatcggacggcttggtgtcacggaacagcagggcagtcaggttacgaatgaatcgcagcaagccatcagtgaaaccagcatcacgcttaccagcaggcatctccagcttcttcagtacttcttcctggaagtcttggttggtcatgccccagctgacaagctcatgcacgttcgagacagcgttggcgtacttggaagacagactaccgttcttgctcagcatgtcgctggcacgagcacggatcatctccaggtcattgaccatacgccaagtagcagagtcgtagttggcattggcttgtttcttgtccagttcgcgctggatggtacgacccaggctcacgtgcagcagttcatgggtcagcatctcttcagtgatgccggactcaacgaactcgggactcttcacgtagagagcctcgaagttgccacgggttgcataccagccacgagccttgctcacaccctcaccgatggcaccgtcagggccagtggtagaggtgatcagcttgaccggtacatcttcacggatggaccgaagagcagcacgcagcacctgcttgcggaaaggatcgttggtgcgggctatcagagcctcagccagaccacgagtggtcaggtcattggtttcggtcagcagatccaccagtgcttggtcagacggagttaccggctggcccagttcaccccataccgaggtcttgtcacggctgttctgttgaacggcttggactacctcagccgcacgctcttccggcaggacttccttggcagactccaagctcaggttggatttctccatcacctgggctacctgctggatgtcctgttgcagctggccttcagccttgatgcggtccatggtgttcagcgtagtagccggagccagggactgtaccgagtcattgcggagcggcttgcgagcagcaggcttggcttcacgaggggtagccttcagctgggcgtcgatagcatcagccatcgtttccgcttcaggattgaaggtgctaccgatctcttcgcgggccttcacagcagcggcacggtcagcatcggtaacgatgtagctaccaccatcggtagcgtactgacccactgcacgcatgttggccagcatgttcagcttgtccatgtcagcctgttcggcgacgtgacggatgctgttcagctgagtagagacggtagtcttctggctttcaaggtacttgccgaactgacgtgcaacctgcgggtcttgaacccacttgctgaagccagcgagggtacgctcgaaggtcgaaaccatctcactggctgccgagtagttcagcatcagcttgaaggtctgctcgttcaggcgttgaccagcagcgtccatacccagtacgcccacaccgtgagcatcgtggatgttcagaacatcttcacccatcagtgcattgtgggagatgaacgagtcacctgcgtgagtagcagtgatgaacggagctacacccggaccttcgttgacggtggtcatgccactggcacggaagctcttcacggactgcttacggccttcctcgtcggtgaactccagaggttcagcgaagtggacttccgaacggtacagtggagagtcgttcagttcacggcgagtcttcgccatcaacatgcccgaatccaggtcaccactggctttcgagaaagcggtgtgcaggatcggttccatgtctttcaactcgttgcggatctgttcgatctgagcacgagtgaggtcagcgaagggctggccatcattgccacggggcaggttggccgaagccagcatctcatcacggcgagcctggaagacagcttcgtacatctggaaagccatgttcgcagtcttgttgatggtgtcccggcgagcgatgaatacctcgtaggtgtcgttcagggcactctctaccttgctacccagcaggtcgtagaaggctgccttgatggcagtctgctggaccggagagtagacggtattcagtgcttgctcgaagcccatgtcggtaggccacagctgacgcttgtctctgttcttcgaggcgatcaggctgtttacagcagagatcaccttggtcagggcagcttggtcaccagcattggcagcatcttccatcttggagtagatggtttcgatgaaggcatcagccataccactgacagcagtctcggtgttcgaaccgaacatcattgcagtcaggggcttcttgatgacgttacggcccttggacgatacaccgccttcctcgttggtcagcacaccagtgatgacttccacagaggacagcagcggttcattgcccagacggtccagcacagccttgatggtgccttcgtacaggtccaggtttccctgtgccttatagtcgttgaactgggtgtacggatcttccaggctgaagaaaccaccctggttcagggtatcgaaccccttggcaccggacatcagcagggacagcataggaccgttggtcacgccatccacttcgccaagcagctgggtggtgaaggattcagcaccgttctcacgggcgatcttctcttgagccagggctaccaagccatccaagctgaagaacttctcgccagcttcagccacagcagccaggattgcagactcgttggctacggtgtcttgagcctcaccacgcaggatctcagccagggcagttacaccagcctggatcgcaggggtgttcaccttgctgtcgtacttggccagcactttcgaagtgttgttgccctcggtcttcacaccaaaggactccagtacgcgaagcttgaagctatccatctctgccttgttggacagattaatggtgttctcccagccttccattgccagcatgtggcgatgcactttgctggtctgtgagttgatcatgttggcagtcaaaccaacacgctgaggcttccacacgctccggtcgaagtacagcggctgctccaaaccaaggtcagaaacctcttggatgcggccgaagaactcgttgaagttgtcgatctgacgtaccagaccatcgttcttggcttgagtgccagcacggttggccttgtgtacgaacccaccttcgatgtctacagcaccagcgatggtggccaatgcgttctcggacaggttgccccacacttggtacatgtcctgacgaagacgcatgggacgcttacctgcgtcgtccaggatcttggccagttccttgggaacaggctgctgagtacgcttggcgttcttctgggtgaaaggcacaggagtgaagctcggctcagtctgaccttcagtcgaaccgaacagcttggccaggatggactggctaccggtgttggcttcacggatctggcgagcgattgcacccggaaccagcttaccgtctacacgctcactgaccggggtcaggaagtagtgcttgactcgcgggttggcaggttcgttggagtccatcagagacttcagcttggcgtcgcttacagtggtgatcttggccacacccatcttcaccagaagggcaagggcatgctcaccaagggaagcttccagacgagcacgctcgttcacaggagcattcggcaggacttccaaaccaaggacatcaacgatcttggcacccagctgggaagctgcggtggcctggcgagtacctacggtgcccaggactgcataggcagcaggagagacttcttcatcggagtccttacccaggatggcattgataccggcatcggtgttcaccaggttgctggcggcatcgatagcccagtcgtacgcaccgtaggcaatggcagtggtcaggttctcgtccagagtaccgtcagcgttcaccaggaactgagcatagtcccggaagtagtagcggctggcgtcactggtcttcgaggtgtatggcttcagcgtacgctcgatgatcggcttggcagcacgttggaacttcatgaactgcttgatggcagactgctgctggccagtgaagctcttcacaccagcgaactcagccatgcggccttcaccagtacgaatcttggtagcgaagtctttgactgctacgagaggcttctgggtgtcaccttcattacgggccggagactgctggaagaatgccgaaaccaggttggtagactggtagcgatcagcaggtacttcctgaccacgtacagcttcaccctcacgcacagcagtgagttcaccagtttcggcctcggtagcaggttctgcctggacttgctcggtttcactgactgggacatcttcagtgacctgagcggtaggcgcctctaccggggccacctcttcagctacctgtacaggcgcttcctgtaccggagcagcttcttgaaccacaggagcaggacgagcaatcggaccagccttgaccaactcacccagggactcagcagagcgggacagtgcagtggcttccagtgctacagcatcacgcagcttgaaggagcgagcgtagatctccagaccaccagccgacttcagttggcgtgcagtcatggactccggtgcttcggtccagttaccggcttcatcacgtacgatacggatggagttatcggtacccttgacctgttgatacgcagcgtcgatggcattgaacttcgctacacgactgtcagcgaaagcacgcagttggtctacctgaccagcagcagcttcttcgttgccgttcatcagggccatacgcacagcgttacggtactgggacagacctttgaagccatcaccaccagtctcgatgtcggtacgtacaccgctcagacccttgagttcgttcagtgcaacctgggcttcgctgaagctacgcagggatgcacgttgctcattggtcagggtgttgctggtatcagctaccagagcatctacttgctccaggctcagggcatccgggttgatcatggtcagggtgaccagacgctcggaggcttcaggctgagcagcagcttcctgaaccagagtctctacctcggcagccttcggagcggcttccacctggaaacgcttgatggcatcacgagtagcggccagtacctgctgagcatccttcagttccttggcttgggcttggcgctgctcaggggtgacgttgcggatctgctcgcgtacgccgctcaggttggccaattcttcatctaggcgggcaacggtagcttcatcagcaccttgcttggcttgctcacgttgttcgatggcttgctcgaccttggtcagaccctcttcgctgaacaggacttgttcctgctccagctgggatacacgttgggcagcttcctgctcgatggtgtcagcctgctccagagcgcggtccttgacctcttgggttacaccgtcagccataacttgttcctggaggactaccactgcaccagcagggttgtaggtctccgaggtcacatcggtcagtgcagtgatgtcgccggtttcacgggcagcgtttacagcctcacgggaagccatatcagactctgcacgagttgccttgttgctgatacctacagcagcacggccgccgatgttcatggttccaccgacagcggcaccgatggttgcagcttcgacgatctcttccaggctggtgtctttcagatgagcaacgttctcaccccaggtctggtaaccctcggtcacgccttcacgagcactggagccgagagtagagcggatcaaaccaccaccttcaccacggataccccgcaggataccggcgtcggctacctgctcagctactgccagagaggcagcggcaagacccatcttcagacgatcgtcagcatccggcagctgtccctggttctcggcctggtactcggtgatgccttcacggtattcatccgaggcgtagcccacgttggtagcagcacccagtacagggttagcggcgtaggccagcatctgcggggcgttctccacagtgtactcgccgactgccagcgggttggttgccgatgcaccgatagcggtagcagcggtctggccaacaccgagggcaccctgaaccaagccatccagaatctcgccacggctgaaggactcgcctgcattgcggagacgttctacgccaccagcagttgcatcagcaatgtcgtcgctcagttcgtcacggcgagtagtgtctacgatgctcgaccagtcgaagaacttgtccacgttggtagagagcttgcggagttcatccacaccctgcatgcgttgaagcatggtctgcggaacaccgtcgtcaccggcagcagtctggctcaggatggcttcgtcgccttcctgcatctggccggagacgtagcggttgtaggcttcgatggcttcattggttacaccagcctgacccatgtcagcagcggcgttgatcgggagagcaatcacgtcaccgagagcacggccagtaccggatacgaaggaagcagcagcgttgaggatctcagtgccagcagcaccgggggtaatacccatcttgccgatgagggattcttccacgttgcgcttcttgcgctcgcggatgccgtcgaggtcgtaagccttctgcgaacccttcatgtccaggcccacactggcaaagtccagagcgtcgaatgccggggtagccccggcattcgcctcttgacgatccgacaggaattgatccaagtcgaaatcagccatctatcgtttcctccttcgtagtgcaaaagttagatcatcggttgggtccatggtaacacccttttcccgttctgccgagcgagttaccttaacggcattcgaccgtttttggttggcgatatccgacacggttttcaggaagttctcccgaatggtcggagcgtcttctcgcatctgagtcatgccatcagtggtcatgagttcgatgatccgtttctccacgtccccggcatccttgtacaaccaggtgttcgtagtgttgaacgcctgctccaacagcttcgacgggactacagcagtacgaccgtccggcaacttgatgccgttggtggcgaagtccacaagcatgttgttcagatcctggcggtcaccttcccatccgaaaccagacttcacagccttgtctaggatcttgttgaccgaacccagcgggtctttgtcaggctcaacaaacgggttacgtgcaacttcccgctcgtagtcttccgtggcagtgcgttgcagagtatccaactcagcgttgaccgcaccgatagtagcttccagcttcgtacgatctcgtggagccagaccttcgagggaatcccgaagctccatttcctgcttggcttgggcaatgcctttggaactgacaccagcctttgcaagatcctggagaatggcgttcttgcgatgcgtatccgaagtattggcctctacgccagccgctttcaaagcatcgttgaaagcatccagttgatcctgggatgctcggctcttgtccggcatgccgaactcatcggtaggcatgccagtctcctggcctacgatacgcatcatctcgtcctgagcctgacgagattcgtcaaagctctggtacgcggtagcgatagtcccggagacaatcttggactcatcccgatcacggcgtatttcattacgctgttcacgagcgaaatccaagttctcccggccagcagccatcgacagcgtatgtgcttccgcagcccggtttgcagcagcctgtgcacgctgttctccagctgcccggtactgacggttggcgatagcatcctgcacgccggagagttccttgcggatctcaccttcgttgatgagttgctgttcagccaggatctggttcacttcaccagtccgaccttcagcagccagagtacgcagctggtctacaacaccacgctgacttacctccgcctgcatgtcgtcgaacttctgggtagcagcggcttggttctgctgggctgcgatctgcttcgtgatggcatcacgggtagcagcacggtccaggttcatacccattgcatcacgttgggcttccaaaccactgcgatagtctgcgttgctgagttgttccagggtggatgctgccacctggtccaggtagctttgcgtgttggcttcacgctgcaacttagcattgttgacattcatctcctgctgacgagagatgatgtcacccaatgcaccgagtgcttgttggacaccagtagtcccagcagacatcgaagatgcactgccaggacttaccgttgtaccaatgttacgccaagtgatttcttgagccattagcgaatccggttccggttcatgtaggaatccacggactcataagccgaggggttggatgctactcgtgcacgttgccgatcttccaggttggtattgatcgactggcgttgagcaccatagttcatgtcgaactgacggcgagactctgccagtttatctagttcagcccgttgctttcggttggcaccaatggcgccgaagacagcttggccgatacccagtgcaggcattacccagccaccggtctgagcaccgctcggagctacactaccgaacatggaatcacggctgaagatgttgctgaagccagacatgaaaccaccaccaccagaggcagcagcgttcacatctacagcaggcatctgcatctgtagttgagtttggggaccacccaagccaaaggaaccgagagtggaagtgtccagctcgactccgaaaggcatatcactgtacggataggccattgttgatttcctctatggtttcgtttatggaaggaagctgtagcttagcatctacgaagtattccgtcagttggaagctagcagccccaatgttccctgcatgcacagtccttgcgaagaagtcgtcagtactttcacccaggatggtcagaggacgattcacgaagtcctcaccctgtagtgcttggaactctaccaaaccaagctcacgacgctggtcttccagactctggagttggtcagcgtagtaggtctggttccgttccagttccttcatgacatccatcagaccagcctgttccatggtctgggattccttggcgataccctggctcacggccatgaggttctcgctccaggtggcattggtagacatcccataggcaccaacagccagggcagctaccgcagccaggatacccagttcaggtccaacagcacggacgaacagcttcacaccgtagctgacggccagggtagtgacgatcatctgtacgatcaccatggtcagagcagccactccaagggaggctgctgcgacgatggttccccaagcactacctgcggtgaagatggtgactgccacagacaccacaatcaggatcaccttgaagaagccgctggcataccaaggggtcttgatctgaacctgcgtgttgatcgccatgtgcaggctacggcacaggagttgttcctgtgctctcaaaccaagctgactgagtactactcggtccacagggatcagtagctcgggttgtccaagctgggctacgtgacccttcttgctggtgatctggtagtgcattgccgggttgtagatgatcacctcgtcgtacatggagtccatggcttgacgggtgtaggtgtaggccggctgctgggtcttgatctgtccagaggacttgtcggccataccagacttcacattgatgaaaccaataggaccaaccttcccagacttgcggttaaccgtgatgccgctgaaggagaagtccatcttgaagtacttgtcccgcatggtgatcatctggtcagccgtgttggagtaatcccccaacttgccctggaggttctctgccttctggatctgagccaatgcctcagagtgcagcagcagcaggtactcgaagatgtaggtaagctggtcctggttcgttgcccctggtggcacaccgtagaacaggactacctgagccacgtcaccaatgtccgggtcagcatgaaccccatcgataagctcatcgatcccaataccggagatcttggccacctccttcacatccctgtaggcattgcctgggatgtccttcacgttcatcttgttgaagcggcagtacatccacgggtagtacgtgccctgcttcgtgtaatccaagttgaacacaccgtcgatggatgggtaggttcccttgccatcctcatagaggaagaaaccctgtgtaccattctgtcgctggtagcgtacttggtgataatccagggacaagtccaggttcatgatcatgcgaaggtcttcctgcctgatcacaccctgggcatcacgccactcgtagaccagaaatacgtagtcttcgccgaaggcattatcgatttggtagggtgaccaccctgcaaactgacccatacctccaatggtgttgtacggtcggcttggtgcatacccagacttcggactgaaaccaaagtcctggagcatacccttgttcgctgtctcgtctgcccatgccacagtgtcggtctggaagacggggatcatgtcgaacaggtagaccttggaacctttgatcgcactgagtccaggaagctcattggtaaggggatcgtactggtacagccgaaccaattcactgaatccccagtgcagggagttcagaggaccgaactggttgtagtaagtggtgatcggcccctcactataagcgatggcttggacaaccacttcacgagcatccacactgttcactaccttggattcagggaggccccagtagtagttattacgctgtgcccagaggtatgcagtgttcgcacgcacaccaatggagtcggacagcttctccaagatgttctcgacgatcccagtctcgtgggtaatcccctggatcacaccagtacggggagagtccgggatgtgagcatcatcgaacactcgctgcactgtggtgttcaccacagtcttcttcttgctactgaacagtcccatgctgtcctccaataaaaaaggggaaccaaagttccccctagtgtacagcacggtgtttaggcaccgacaccagtcattagcatgttcaccacacgcccgacgttggcatcatccagtcggttggtggtgttgacttgagtaccggtatcagtggtacggcgtacgttccaggtatcgatcaggatcttggcagccttctgctcagcatcacgcttgaagccatcagcctgagccttgtacaactccttctggcgaccgatcacagagtcggcatccacaccagcaccgatggtttgagcacgttcggaagctaccttctggcgtaccagaatggtctgctcctgggtgttcagaccctggtccttggtcagatcgaactgagctttcagcagacactcttgagccacgaggttcagcagttcctgcttcatgttcgcaactttctgagcggactccagtacctgctgttccatgaccttggtctgttggacagcggtcagcacgtcttgcttggtcttcgcagtctgctctttcacgagcaagtcttggaagccagcagacaggatctcttggtcgatccgacgagcctgtgcagtctgtaccttggtctgttcctgaaccagaagatcctggaagccagcagacttgatctgtgcttcgaccaacgcagccttattggcggcttcatacttctgaagcaaaaacatcacggcgttctgaagagcagccgtgatgccaccagtgagaacagctgcgtattcctgccccttcaaccgtcctgcatcgtgctctttagccagatgcaggcgggtgacttgcaggagttggtcgagagcacctttaccgtctagcttgacctcggtgaggtcggcaatggtaatcggctctacggccatggcttagtcctccttgaaggaaccgttgactgcctgctgcttgcggagggattcgagttcatcctcgctcagctgcggcaggatctccacggagaattcacgtaccgacttcgaccggcgtaccttctgcggacccatcggggtctgctcggtaaccgtgtagaagtgctggtactgcttggacttgatgaagttcagcagggcttccggcacatgccagtccacctcgtacggaaccagacggcggatcgtaccgatctcgtcattgccgatgctgaagtactcggcatcccagtcgttcttgttcgggttgtggcaggtgatgcggcagcggatcagacgatgcgcagccagccggcgatcacgacgcagttcaccttcggtcttcggacgcggtgcttcggcggccttgagggcagctgcaccagcttcggcggacggcttcgggatggacgaggtagcttcggtggcttcgtcttcttcctcgtcgccgacagcttcgtcgttcaggacggcattgatcttttcacgcagcttttccacgccggtattggagcggaaagagatgcccagggcagtagctttttcttgcaggacttccaactcggaacgggtatccggggattccagcggtgcttcactcaggttttgcagttcgtcgagggacatgggtgtttctccagggtaagagttaaaagggggaggttaccctcccccgtgcctagttacaggcgtgccacggtcttcagcagggcgatccactcggggcggaacaccatgaagccgtagtaccacttgatggacatgaagcccatctcgccgtacggatcactgcggtcggcagtggcttcgccaggacgcttggtgatgatcttgaacttgacgttcttgccgtcggtagcgaagccgacagtggtgaacgcttcggaagccacgcacagcatcgggaagacactgtacttgccgccggattcgtgcatcggaacctggtcgttcggatcgacagccttgcctacgccagcccagtgcatcatctgcgggttgacgatgacgcggaagcgacccagctggccgacttcgccgtgcatggtggcaccaccggcagcgtacttctcgatggggatgaaggccggattgccgtggttgtccttcatggcttcgatggtcggaaccagatccgaacccacgtacagagcacgagcgttacccacggtgcgggtgtcgatcatgcgggtaccggtgatcatcttgatcttggtcggcgcacgggcgttgtccaggtccagacgcagacgcatcagcgagtcgtaggtgacctcggtggaagcatcgacttcagcgtcggaggttgcagcgcccggatagcggacggtgccggccgagttgagcaggtcgatctggagcaggtcttcggtgatctcgttcgcgcccttcaccatttcggtggtgacgtgaccttccatcgccggatcgctgtcgaagtcgagttgctcttgggtgtactcgcggaagaagccgtacttctccagcttgcccttgatctcgacacgcttgaaaccaacacggttcacacgaccgccgatctcggtgagggtcggcatcttcgcagtgatgttgcccacgtcacggctcgaaccatagaggttgccgttggcgatggtagcgccggaagcgtcgatgccctggtcgttcacgttgcggtcgtcgagcagcgggatgtagtgcagtcgcacgatctctttgccgtagttcttcggcatcgagaaggtgtcggccagctgaccgaagtacgcttccttggcggcgtcgatgagcgcacgcttgtaccagtagcgagtatggatctgaggaccgatggaagactctaccccgttcgcggggtcgttgtacttcatcggcttgatgttatctacaggaccggccatgagatgttttccttattccagtttcaggtattgcttagttgaagcccagcttctcgaactcttcgtccgacatcgctaggggatcgaactgggcgggcttagcctttacagctacagttttggtcggagcagcagcccgacgtttttctttcacagccgcttcctgtgccttggtgcgggtggtgactcgcttcaccggttcagcgggtgctttacgttggctttcagtggccgaggcttgagccaaatcgtcgaatgcaccttgagcctgaagctcatccccaaccgccttatatgcgtgcaggtacggggtactatcagtgatcgtgccgaatgccttacggcgctggatctcggagtcgattcggtcgaataccccattggtcatgtgctgttcgaagtagccgatgacttgaggatgttcggaaaccaacttctgagaagttttatccaacttgcccagcgtagtaaccactcggttgtaggatggactatgctcgatggaatcgagttgttcgtccagtgcctcacgaacttggttgaatggtacagcagtcggtttgtaatccgcaacactcttctcatccaagtctagcggatctacaccggcatctttagccaacttagcgatggcttcaggtttcttgtgtttgagaagatcaaccacattggcgatagtctccgggttcagcaaaccagcttcatccagttgacgcatcatgtgcaagttcggctttagtgccgacatcttgtggttgtagttggcacccatctgcatcagacggatagcctcttccggcgtcttgacctggagatcacggccattcgctttgaacggtgcagtgatcttcgccatgaagtcagcaggatctacctcttgcttggtagcctcggacttcttggtttcaggttcttccttggcaggagtatcttccgattcttccttgccttcttcctgttccgactcttcttccgtcggtttgtcttccgcaggaagatcgccgagttcatcgtccggcgagttgagaggatcttgttcctcctcctgttcttcttcctgctcttcgtcagcaggctcttcttcctggtcggcggcttcaacttgctcgtcgtccagttgttcctgctcgggttcttcttgctcggagcgagtctgctcttctacttcgtagaactcgggcagatcgtcgtcactcatttcgaggaagtcagccattactcttcatcctcctcttcacggacacgttcgagttcagcgtcacagtccttgatggcctgttcagcttcgtcgccacgtacgccgatcagctggaagtaggtgtgcagagcgccgaccgcatcgatctcgcggatgatgcgagcctgcatctcgggggattccatgtttttgtccgccttgagcaggaccagacgtgcagcgttgtccttgaggaagtcgttgaggatcagcgcctggaagtcccggttcttgtgcagacgcagcattgcgtcacgcaaccggacgaacttctcagcgttcttccgggtgatctgaatagcgtgttcttcgttcatctttgcaaatcctgtcaagtaaaggggtgttggttcaccgtaaaggtgaaccaactatagagaagttaactacttttgggaagtccttgctgaagtagcttcttccagtcgcttcagttggctgttcaacatggacagcttgccttgtgcttccgactgagcctgttgcagttcacgcttacgtgcctgctgtacaccggactcctgttctaggaagttcaggtcggtcatgtcagcctggctggagagagcacgagccttagcttgttcagtaccaaccttcgaattctgcaagccagcaccagacatgtagttagcagcgcgtgcacgttcagcttcgatctgggcctggagcagcaggagttcaagctgtgccttctgctgtgcaatcggatcaggctgcggctggaactcacgaatacgcttggcaaactcaggcatcttcttcagttccatgatctgacccatgatctgctgagccatcatcgggtccatgttcggtcccatggtttgcagcatgaaggtcaggtcgttgaccttggcgttgtcctcttcagcagtagagatgtccagcttgagatcgaagttaccagcaaggtcatccctgcggatatccacgaagtgctcattggtgatccgtaccacttccacatcgtccaggaactcagcgttcatggcgatgatcttgcgaccgatctcgatgatccctgccgagagacggcgaaggataccaagctcacgcttggaagctgcgtccaatgcaccgcgtacagcagtggcagtatcacccagtgcagcaccagagataccggagttgaatgccttcaccccagtcatggactctgcttctgcctgctgcatgttgatcatgtactgggcagactgagggatctccgggaaggtgtgcatgtgcactgccgctcggggatctgcgccagggttgaactcgtagttctcacctcggtcgaagcggcgacggttggttacgtccagtgcgcctttcatgacaccgacttgaccattggcagagcgagccatggtatcgatcatgccacgagtaaccgcaccgatgatccgttggttgtcgatgagcagagcaccatcgctctcaccgtagagatcacgcttcttcgggatgtagttgaccaccacgtaggggatcttcttgtccgggaaggggttctcttccaggcggatcatcacagcaccaacccaggtagctacgatgggatgcagtacgccatcaccgtagatgtcgtagtagccccagtactcgtgaaccacgagacgcttccggctcttgtcctggaagtcgaagttacgcacaccttcggatgggccggtgtagtcaggctcggtcaggaggttctgtccttctacctggatctgttccaggttggtgtagcgaccgtcagccttcaactctgcgtaggaactctcgaaggtttcgatgaggaacttcgccttgctgaagtcactgccacaggatgggtcgatcacgatgttgttgaagtcgcagacgtgagcagtcggatggttctccaccgtctcttcacgttcctcttcttccgaccctactggcacagcacgtacctgagtgcccgtggcttccgtctcttccaaaccaagacgaattgcctcggatacttccgggtactccgaaggactttcttccctgatctgcgcagcagtctggtagatctgggccagttcttccgaatcgtcagggatcatctcgtaggtgatcacctgctctttcaccgtccgggtctggtagttccagcctaccttgacgatgatggtcccctcgtccacacctgcacggacgtactcgtcgatgaaccgctgcttattcaacttggtgttgaactgctgattcagtacgaggctgttctgtcgtgcagcttgggcatcttcccaggtgaccgggttgacttcgaagatgttgggactcgaaaggaaaggttcagacagcgaagcgtatcgccattctgcctgcttccgaatagtcggaggctgtaccgcagacttacccttctccgtcttgggcttaccttctccacggacgtgcatgtagtccaaccaacggttgatctgtacgatcttctcgtcggtgacttgcttcgcctccttgtagtcttgcttcagctgagccagtgatggagcattcttccagtctggttgcagcttcctgtcctgatccccatcttcattgggtagggtcaggtaatcttcgtccacgtctgccatagctactctctttcaaaccaatgaggaatgaatcttggaaattaaacaactgagcccgaactttaccatgcccgtgcgtgccagtgataccgcaggagggtatgacatcttcatgccggaaggtggcgtggcctatccaaaccaaccaaccacggtaaagctgggcttctctgctgctgtaccggaagggcatgtagctctgctgctgcctcgctctggcgtaggtgccaaggccggtgtccgccttcgcaatacctgcggtgtcattgactccgactaccgtggtgagtggatggctgtcatctccaccgaccgggaacccttccgatgggcagctggtgatcgtcttcttcagatggtcctggttccggtaggaactcccgaacttcaactcgtcgaagaactgtccgaaaccaatcgtggtgaaggcggcttcggctctactggggaataacccatgcaactgatcaaagagtacgaacacgccaagcccctcaagttcaagggctggcaggtaagtgaagaccacgagcagaacgtccaggctctgcaagaaatgctcggcgccttccccttcatcacggctgcattcggcgacaatgccgatggcgaacgtgtctacaccctcagcaacttcaacgagggtgcctccctggacgtgaagggaggcgaatggatcttcgtcaacgaagagggttccatcgaaggctggtctgctgaagtcggtgctgtccgcttcaaggaaatccaggcataaaaaaagaggggaccgtcctggtcccctcacccttacacccaacctccccttgtgaatcggtcctggtttcctaccggatcgatacgcaagttctgtgcgtccagattcgcacactctgcttcgtacttctgcgagaagttgaacccctcttgtgcagtgttctccatgaagccaatcggagtctggcaacgtgaagcaacaaagtacagcagagcttggaggtgagtataaggcaaatcaatgtcgatgcaaccccaactgtccaggttgtccacacagatcttcatcggtgtaggtgcacgacggtaccgtacttccagagtcttactcgacgaatgacagtagaactcatcacttatctccagtacatcgaactcaggagtagtgatgttgagcggctgccaggtatcgttgaggtagtactccactccattgtccccgatgatcttctcgatcttcaggatggactgtctgcccagcttgttcccctcagtgatgaactgagatactccaggcttaggcttctgtcccacttggtacgcaggacgtagaggatacaacctccgaccttcttcaagttggatcttcagcataccttccttgagcaggaacctcttgtgcaggtccagtactccaaggttgattgcacgaatcagcgaaggaactcgctccagtacgagagcaccagtgtcgatgttcacgtacttgatgttgctgagttccccctctgctagcaggtcaatgacctgcttgagttggattgtcatacgatgtagctctcccctgcttggtaggtgttctctcgttgagacgcttcttcccagatcatctcgctgtcattgtactccatgcggatctcttggcttggagggattggattcatcaaagccagcatagagatggtgtccaggaagtcatcgtgcttggacctgaagccaccagctgaagccaagcgaatctcatcctcgaactccaccatgcaccgggtactcttcatgtcataggggaagaacatcttgcccctcttgaagtgaggaaccatggccatgaaccgctccagcttgttggtggtaggacgcaagccaggagtactactacccttctccgaaaccatgtggaagtagacatccttgttcaccatctcccgttggatcaacgggatgtagccaccctgctggccagagacttcgatgcctaccccaagcggacgccacttggcactcagcctgaacagatcatccaggttcgctcccatgtcctggcgttcacagataccatccacccacagccagtcctcgttgtgggagtaagcccagacactgatcacactgaagtcactcgacttcttcgcagaggtagcgaagtcagtggtgatgtagaagttgtaccgcttcttgttgtccagcacgttgcgtcgcatgtaccaagccacctcaccatcctggatgagccggtcttcgtcggacatgatctggagcataagctcttggttgaacgtctcgatcttccctgccttcttggccagggtgtacttctgcaacacgaagtcgtaggtgaatcggtcagcccatgcacccctgaactcttcccgagagcaagggaaccgctcacacacagggtaaacgttgaccttccaggcaccagactccaccgctttgtacagagggtctttcgcgttgaacggtgtacccgaccagatgatcatgttcttcttcgggtgtagtgcatagtccactgccttgtacaccgtgtcttcgatggctgcgatgacggttggcgagcgagcatcttcgtccgaaaccaagtcatccagtaccgcaagctgcggacgcttacccatctccttcgcaccacggacaccagtcttggcaccgtagcccttgacgatgaagaccttcccgtccaggttcgtgaacttccagcggatgtcagtgaagttggtttgggggatgtacttcttcaggaactcagagttctcccagcggaactccaggttcttacgcatgttcttcacaccgttgtcgatggagtccgacacgtacagagcaaggtctaccttaccgaaaccaggaagctcaccgtacagtgcaatgtacaggaacaggtactcacccatcacggtggtcttggctgcaccacggaagaccatgttggcgatccgagtctgaccagagccaatctggtcaagcatccgtaggtgaagcactggtgtcttgttctcttccccttcgttaccgttgaccatcttgatgaagtcaacgaactgcaaggcaaagatgctggggatgtacgaagagtcatccccgtagactacttcacgaagccattgctctacagacttggcagcttcatccaaaccatcgaagtccacctcacctgcaacagccttcgctattggtgtggcgtccagattcattcgatgatctccccttcgatcacttcaccgaagtccatgttgcgctcggctacatccttcaccgacatctgtttgcctgcgatcatctcctgctggagacgggcaagtgcttcagcattctgccgcatgatgtcgatggcatctgctgcacggtcactgacatcgatcttcagttcagtcttctccggcgacttcaggtgagtgagcagactgttggccgattcctgctgaaccttctccgactgagcgttctgcatcaggtggaacagatggttgatcgccttctgcttgatgtcagcattgagcacatggcatgggatcagtgcctgttccaggatgaggttcaccagcttcgacttgttatagctggtgatgtagctggccatgtccttgttggccacaccctgttgggtccaccgctggatcttggtggggaaggtacgggtgtaagcctcggtgttgttcaaccccatcagcttataggtcacgtacttcgaagcatgaaggtagttgtccagcttgaacttcccttccttcatcacatgggtgtacccaatgatgttgtccctgaaggcttccgccatgtcaggatcagacagcatgtcattgagtgtcttcagtacttccggggagatggacttcttcatcttgtccggtagcacggagcggaactcatctaccgtcaacatcccaggctgagcagtagtggcgggggtggtggtcatcttagtacctcggttgtctataggttgtgccgaggataacacaacgtacaaaccaaggagtaaaccatgcaactagaaccctatgcccggcacatcgtgaacggggaactcatgtcccgcaacgcacgagtggagtgtggcaccaaggtgttcctcctgaaggacacccttacccacaaccccgccactgggagaacactggctctcggtgcaggaagccaagtgatcgtcatgggtctgtgcatccagtacaccgagaaggggaacatccctatgatcgcagtccacagtatcaatgaagacggcgacctcttccatgccctggtagatcccaaccatctctgctatgcagagtgcccggtggatcgtgtactcaagctagttcaggtagaagagatggcagcgctgcttcgtaacaatggatacgagcagtcacataaagtagctgaacttatctacagctacggtatccgtcagctgcatgaaggtaggctgtgatggacatcagctatgctcatgttcagatgaagctgaaggacgggaagactacctctcacaaggtagagatcccctactcactcagtgaagtacagggtgacttctactccactgtagctcgtatcctcaacctggtacggagagagactggcatctctgttctgaacgtcactcactcacgagtactcttcactgcggggccaagccaatgaaagcagactgggtgtccaacctgatcttctctctggtttgggctttgtacgtacccaagccagagaacgagaactacctctggctcttctgcctgcttcacttcctctttgccctcctgctgtggacggcggtagacgtgaccaggtactcaccccactggcgggacaagcctgtcttcgccttcatcatcttcgcccccatggtaccgatgaacctgtacggggccatgctggcattggaggttctatggaactcaacactactgggatgattcggttcgtcctcaccatccaagggaagaccttctacatcgactcttccctacccccggaaatgtgggaaggcagaaacaagacccagcaggaaaactaccttcgggagattctcatgtcccaggtatccatcactgcccagctacccgccacggaggaagccatcctcaagaagcgggtgcatgaactggagcaggaggtagcccgcctgaagaagcaggctacccctaccttccgctatccgccgggtgtaaccatcggacatcttcccgaccaacggtagtattccaggcacaaaaaaggaggccttaaagcctccttatatcccctatataatatataggtaatcccccgtgggtgagtaataccaagggtaccacgaggaattaccctcgtcaacccctcgctccgctcggggttgactcgggccgcaggcgcgaggctcactactccaccacctcaacgcacgtgaggcttatccccaatgagcaatgaagcagtactgaacatcaagctaccaggacaagaactggtagagatcgaccttggtatctcctggcatgagtacatcaacaatgcaggagatgacaacactggcttggtttacgtcaagctggctgagtacgctgaactgtttgatgtagtacctaacaacccagcagagaagaagatagctgaactggaagccaaggtaaaagaactggaggacaagcttaaggctacctctactgaagagaacagggagagtttcctgtgcagggttgccagtcgtggttctcgtaagcaggctgatatctttaagaaggatggcttgttctactgggtaggtaccatccgaggtacgacactcagaatggagagtaccttcatggatgcagacttcgatcctgtcatccgtgatgcaagggattgggtcaaggctcctctgctactgaaggagaaccttggagtactgacccaatgtgatcaggtaaggaacttcagactggaggtctattgggctgaggctactggtttgttcaccggtgttactaccaacctgaccactggcttgaccttcgtagcaccagtcaagttcaagaccttcaaggattcctggaaggacatccactactacatccaaggtaaggagtagagtgtgtatatcctgtggataacttgactatagatatccacaggtatccataacccatagcttcggaccagtcatcctgctcacctcgctgcgctcggtgcttggcgacttaacctcagctatgggttatgggagcgagggggaaagggattggtttggggagggaaaggatttgggttgtagggattttgctcacagaagtatggatgcagtacttcagtctgcggctctacaaatccggttatcccccccggtacctctagagttttggaattcccgcgctacctaccccaccttgtttaactctccttctacccaatcaactgtctgtacttatagagcaagagaagccttcggctgtgctgtggattgatcctgtgtcaccacaaccattctcactactctggagtactaccatgttcaaagctctcaaccaattcttcgccatgctggaatccatgttccgtgctgtcaccaacctgaccaaggctgcggagaacgtaaccgagtgggctgaagaagagtctgctcacttcaacaacaaggctcgtctgcaacgtgaacaagccatcgcactgctcaacatcgagaacgctgctgagcttcaggagaaaggtctgaccgaagctgtcgagtctgtccgtaaagaacgctccaagtccaaggcttaacctctacccagtatccctcactccctaacacggagtgggggatcacctttcaaagcacacataagatcaagagcacacacaaagcacacatctctctcagggacagtaggttgtagggagatagggatactctctctgttggttgttcactctctacctaacagtcatctctctcgtgtgtaggaggataggggagatatgggt

SEQ ID NO: 8 - DNA, 93335 bp, Myoviridae Pakpunavirus
  misc_feature (1)..(93335)
gcttacatccgctctcattttgcaatgagaattgcgtacagttcatcatgcgcctcagaagtgacttcactttgcatgcggatgcatgctatagtataccctgtgatagctccgctatcctgttttgcatggcacacgaattgcataagcatgacaagggtaaccctcgaaagcggagctttcaaagtggtctgtgaagtgtaggctctaccctttagtatattgcgaccggaagtggtgacactgaaaacattgactccagcccagtaaacacggtaaactaaaaggtggatagctgccgctatcgagtaaccaacattcacacaaggaggcacaatgacaagcaacaatcatgccaagattcacatccattacgctaagcaaatctactacgccatgcgtaaacgtgtcatcgcaggcgatgagatatgcaaagaatgggccaagcccaaaacaggctttgaagcgttctatgattgggtggtgaatgtgtcagggtacgccgtaggctaccgcctagataagaacatcctctacccgggaaacaagctctatgctccgcatacatgcgagttcacgcctacatacatgcacactctattctccaactgtgacaagacaagcaataaccgtgccaatacgtgggatagctatatccctctaggcgtccgcctagcacgctatgacaagtacgggatgcctgtatacgttgctcagtgtaggacacttggaaagcaatctacccttggatcgtggaacgatccgatgcaagcccatgcggcatggcaacatgccaaggtagcagccatcctcgaatgtatcgatctctatcagatggaggatgttcacagtgtaaacgttgttcaagcgttgcttgagagagtggacaaacttggcaaggatattgcacagggaagagagacaacccttttgcaatgatttgatggggtcgatggtcaacccttcgagagtgtcctatcggggtgcgagaactccgatagcgaagctatcaaacgtatatgcatattccatgccaacatgtggaaagatttcaccgggcagggcgggagcccgttggcattagttttgcatagcttagctgtcgctaagaaggaaaaccctcggccacccattattttggatttactaagggttagggtagcgaggtgggttcgtggttaagtagctcggaaataaatccataactggcagaaggcgaaccagcagagggcaggcccgctccctccattattttcccagcagtagaggaggcacactctacaaacgtatcactctattcggcgggggggtttaggattcgaatatacctttagcggctaaatgccatcattgcttatttcctattttcgtgctataatccttataggatgttcttattcttcattatagctggataagcgatggttgtatagattcaccacaaatagaaggaatatagaatggaagataatattcaagctccgcttgcagctagtgcaggtggcaaattcgcaactgtatacgaagctattgtcgcactcggagtagaaggggctgccgctgtgtacagggtaggtgtagggattagattgacaacagctagaccatcggcgtggtaaagagaagccccgggcagctttcgctgcccggggctttttattgccttgagtttatgtatgaagagattccagttgtctctgctcttccatatactccctagtggcgtagttcatcatgagggtgcaatactcttcgtttatctggtccatgtattgcaacactttctccatgctctggcacggactgaatccgttatgacggagaatcttgtttagattttcacttccacagaagtctctggcccaagcctccaaagctactgcgtagaggcttttgatgcacccgataggggctggataccaatattgctcagacattagaccctcccgaacgttacgatcacgccttgcttggctagggttgcttgtagctcatccagtgagaggggcttaccgcccacgatgacatacttatctgcctcttctagagtcatcacacacttagtctggaaggtaggcctatacaaggcgtacgtatcgggttgccacttgcttcgcaggcctgttccgtagctaatgaaccggtcttcggaatgatcccggatgtacaggcaccggggactatcgtctggcccatctacggagatagggtgttccatccactccctgatcttatcaacgacgccctctcctaccttcaattgagcgtactgacagtactcaaggaacgcatcaaactgttcggcagtgaaattgctgacatcgatctctttagttttcattctcttcctccatgtctgcaatgatttccttcaacgcttgaagcgtgtacgcggtcactttcttctcagtgacgaaatggaagtctacccttcggaagtcgtaggtcgatttcgagtatccaatggcctctttgagttcttcctcgtaccacaggaatgtcattggacttccgtcgcttttacgagtgtagtccagcagattatctccaacccacagtagcacttgaaccttgtcgtacatgaagccgtttccgctcccaaactcgataccataagccttaaggtgctgttgtactgcaatgttctcttcgggggtcttcacaatagtgtaaaacttcaccaaacgctctttcaatttcattcctcctgtctgtgtttttatgggagtgtaaaacgttcccagtccattgtcaagccttctgtggtgatagtctgttccagacgctctctagctccttttagaatgatatcccactcatcgccttcttggacccctacatacttctccatcatcagcgcacgatcaacaagcccagctctgtagttctgtcgctcttttctacgcgatagcactcttgagatatggtccttcttctttgccaacacgctgatagctttccttgccataagagttgcatactcgctctcctcggcggtcatccattcctgatacagcagccctagacgagtgtcatgctgtacgagtggaaggtctttccatatgatacctactcgtccagtatcagagacggctttccattccagcgtagtgccggtcttatagtcggtgatctttacattctccgagttagattgagactggaaagcgtgcctccagtctcggtatacagtccaccgtttccagtcgaagaatgtctcacagatggctttaacaggttctccgattttaccctccagttctttcaggcggttctcctgctcagcactcatgtatttgataggtcgggaggcggggtcgtagcactcctcgacccgggcctccagtagtttaggctcctcgttccgctcttcctctcggaaccatgcgaacagcttcttaaacatattcagtcctcctctcctgtgatagctaccctagtcagtctccacacttttctaggtagactaacgaggaatagcatagccataaacggtacggcgataggccagaatattccagctaacaccgctcgggcctctttcttacgcctctccgtactttctcccctccacccaagaaggggtcgtagagattcccatacgaacatccctatcacagagtagaacaataggcagaccactccgacgactatgcatactagaatgagaagccctacttgttccatggtgcgatcctcttaagtagtttacggctgttccagatagacagagcccacttaggtaacaacaccactttcaaaacgctgtatgttgcgtagagtagcagaaagctagcatacactgtgaatgtaataggccatagcagtcccagtacaatggcaaaagcctcgataccctctctgtgatctttagtcgcactagctgggaagttatctttgaaatactccgtgatacccatgtaggtccacatgaacacaattccccacgcgagcgcgaggacgaatagcattgggattatctccattactcccctccttttcgaatcaagtcgaagtaggcccacacgtagaagttgcaccacgctctgcctatggcccagccttcccaatagtcttcccagtccttgttcggagggttattctcgaacatggataacacgcatgaatcagctacttcgtccaagaggtgcattaccgaattaagcggcccgattccaaaggtcttatctagccaccccttaaatcgtccaacgtctgagacggtgacgctggagtcactgcacagtgccaatctctccagaatgtagcacatgtaaggctcttcttcgttctctaagaatgcccgcatgccctccttgattagcggtgcaatagaattagagttcattgttttcctcctttcgaatcaggtcgaaataagaccagacataaaagttcacccagtttagatcagtatctagcaggtaattacgatgaagaagagagataactgaatcccacgacggaatcccatgctcctctagtagccactctctgaatgacctatactctccgtgggagatttgcccttcttctgctaggtcgcttagaatataacacatatacgtgtcccggtcgtttaccaagtaatcttccagtcccatctttatcaactctgcaactgatctcattgtttcctcctctgagagccccactagggctcgaaatttttggttcgacctccggtcaacacatcacaacccagttgtacaggtcagcctcctcataagctgatgggtagcgattgtactccaagaagaacgcatggtcaatagctgagtatttggttgcgaaactcgtaatgtaagtcagaaacccgttgtcctctttcctgaacagggcgtattcttcagtaccgtccttaaacgtatctagcgagatagtatacttatcgaagatcacagcatttcctcccggctaatgtagtagttgtagtcgtcctcttggacgaggaacgcacgatagaagcctttctcaaagtctcccttgaccagcaccagattgccctccaccttgcatgtatagatatacatggtgtttgctactcggataacaggatcatccccgggacgaacatccagagcagccgacatagcttccattggcatgcttgtcaagtgagcaaccacggcggagcagtattctgcgtcccgtcccgaggtatcctctgcataagcaggagcgaccccgcatgaatgcagggcaagtgtaaacgcaacggctacgagtttcttgaacatactaaccctcctcttggtctgtctggggaacatccggcttggggtagacgaatgtctctggatacttcatgcatcttagctcatctttgcagaacccgtcaatcaatttctcatgtgcgaattccgcagccttgtagtagcgattagcctgtcttgcctccactcgaaggaggtggcttatcgtgtgagcgttgatattactaaggcttgcaaaaattgtcaagagcttctttgcagagagggggattgacctttcgtcaggtctgtaccaatcaagtctggccactccttggagaacgtcgtccacccatagagggtagtctccatcaagctcgaccatgacttcgtacatttcaggctgaacagcgttgaaaaagaaagagggctttcgccctctgctggtatctagaggaggaacaagccccctctccaccttgtgaatcaaccgatcagcattcgcccctatccgagactttagctcctcgatctcttcacatgtcaacatacggagggcacaccttagatttctcgatagtgaacacgccttcgcatgtcaggttagcaggtccataccacttgaacatgttgttgatatcgtatcgaatcaactggcggaacttctgcccgtcgcacatatccacgtcgaaccacgccacgacccatctgacgtaatcttcagggtcgttctcttctcgccacctgcactctagatcaacatgactgggctctagaacgtaaatgtcttcgaaccctgtactctggttgttcttaagtcggatgattcgagcgcgaatccattgcatgcacctgcggtttgggtctgtgatatcgcagactaccggaacctctggaacctcaactgtatacatgattgtacctctatttgttttacaagaacgccatgattctgtctctgtctgcatggcggtacagattgaagcaaggcacgcctctagaggacgccagttgccaagcggtcctagtcccgccttctggaatcccgttgtggtctgtcttgctccagcacaccaagaacttgctaggcgtgttgagatcgattcccagcacttggaaaacgttccgagtgtgggctcgtcttgcgaacgggcttagaacggacctcccgtcatttctgacagagttccaagccggatgaatttgactggcaatgcctttagcttcttcccattcagccggcaactcctcctctggcaggatggtagctccgagcgtctccgttatctggtactggttgaagccgggagacggaagatagatttctgccgtagttcctccattgttattggatatataatccagccagcccgattcgaacgctgagtccgctcccttcgctcctcctgaccgaagaataaaaccttgttctgccagtttacggcctacctctcgaaggatgccccattctctgttcggagtgtccctacttccgactcctgtgtaatacttcataagatcaccattttggatagctcttctggtgttacccattgatgccggtattctccgttcttcgggttagaatattccaatagaacagggtaatactcgtctcggtaatcggtgtctataacctcgcagttccaacctacagggataggacaagaacgccccttgggggccatcttagtcccaatagacaacctgccttgactagccgcctcattgacgcttatcaggctgtatctgtgttttaacgcttcaactaccttgacttggaggtctaaaagttcctcgattgtaaagtggcttacatcgattgtcatattactccctcccttccagtttcttgaattctttgtccagcttagctagatgcttatccaacttgtctagctttttatcctgataaagctggaaagcctccgagcccggggccaaccaagtccccttatacttaattgcaccccggatcatatctcctcctattacagttcgtaaacgtatacctgaaactggccgagcgtctcctcgataagaggctcgacattgctccagtcctctccggctaaaccgcagccaatcttcggcagacctacacacaactccgaggtaggaatcgcccgagcgtcagcctctgcctcaaggaacagagacatagtgtacagggcttggcccagtgcgtcaagctgagtgtagactcgtccctcttctcggccatagttgtactgcccgtacagattgtaaatcgatccatactcgttaattgtgaaggtgagggagccgagtttgcctcgatcccctttcaccgttgcttgatctgcctcgtaggcctccgggaattgctcccggatttgcttagcaatgccgctgcccatggtgttgaagcaattagcctgatgtgcaatagcgtgcaactctttgtttttgaacgcggcgataagatcgccctttcggtatttaatcatttgaacctctctacacttgtgtatctgatattcaaaccttccgcatcagctctgatcttatcgtacatcaagtctaatgctgcgaatggagaccagtaccctttctcccagattttaaacttgaacaatctatgtcctttattctctggtcggccttgctcacagaaggttgtaaaataatatttagccaacatcctcgcctccttacacgccgttcttaatccgataacggatggactccagatcattgttcttcaaatcttccgtgtcccacttaccgtctttgaagaacgtccgcagatgcccggtagcttcctcttccttcgacacatcatccttcagtcggaggaaccgtccattgtcttggtcccggtacactttcaagagacctttagccgacttcttcttgctatcagtcttggggtctttgaagattgcaatgccttctccattcacctcggtgtaggtggccttcactgcgaacccgaaggtgtctcgggtattgcactgataggtgtaactcccaactccgaagaccacgttcaaggatgcgaaacctttctccttgagccgctccaagattttggctgcccgacgtgtggtgatcgaatccccatagatcaaaccgatatgagaatccagcatcttataaccagcttcgtttacagtaccaccgaaggtttcccaaagaacttggatagcacctttcacctgagcctcgctaacttcctctagtttatagccaactacatactcgtactggtcccactcggttggaatgaccttgaaatatttatcttcgaactctagaacaaaagcgtcatttccgttgaccgcatccatgatatcccagtgctcaagagattcaacaacttccacatcgcccagtccgcagataacctctacaggatcgccagaatcgggacgaacaaccagcttgccgtcacgttccatgatctgatccttgatggacggcagaatgtcagtaagcacgccccagaagtcgaagctgtctgccacgtaagacagaataccactcgggaacttacccatcagttcaacaaggaatcgacgttctgcttcctcacggccacctttaccttctccatccttcatttctttctcaatgcggaggatgttactagtagctacagcgtgttcagtcgcaggaacggagcaagctaccaaaccagtcgcgttatagtagtcctcagcataaatagctgctgccaaggtgtccgaacctacgaacgaggtcaagtgaccaacaccgctacgggctgcgtcttcgatcccgctcatgccccgggcactgaagtcgtggaactgtacagacaacaggaagtcgtcgtagcacccagtgtggttcgcgtagtaccggcccatagctgcgtattctgcggcaatggttgcgttggttgcggtcttccaagtcatagccgaaatcagggtctcatggtagttcaccagccagtagaactcaggcagggtgttcttgattgtgagaacaggcacacccatcggcacactgacgccctcggtcaaagacttaacctccagaggcagatagccgagcttgtgaagggcgcgaagctgctccacggcttccatttcccggccaaaatagccagtcaggaaccgggaataccggccaacggcgttctcttcttcagccgcgaagaagccttcccaagactctacgatctccatccaagcggcccgtccgccgacccacttgagagtgccgtcgtagaagtcggtggcatgcgtctttcgataaatcttatcggagcgaggggtcaggttgctatagacaagctgagttccttccgagtacatggagccgtgtccaatcttgtacccatcagtggaaagatgcggcagaattttcatgttatttcctcctgttgtgttgaataggcccagactacatcaatctgggcctcctgtcaatattcgacttcttctactggcagcgtcagcacagggtagatgcatggaaggcgcagcaatggttgcttcttgctgtggaagtcttcccaaaacttatcgtgcatcgtcttgtaccgagcgtccagttcctccttggtgtcgaactcctccaccttgacaaccctcttctctggagccgaacgcttatactctacaatccagatactcaagctcacaggcgttccgccttggagtattcaaccggaatgacagtcagcgcttcgtgctctttttgagggagcgtatccgaggtgtagatgcatccgaaggaatccagcaagcagtcgatacccttactgaagattccatgagtgacgaacaggtcagggagcactttactgtactctcttagggccttagacacgcttcggaatgtagcacctccgtcacagatatcgtcgatcaccagaagcggaagttcaggatcgatatccgaaggattcagaatttcaaagccttcgattttaccggtctggagatcgcgcttcttattgcaacgaattacagcggctgctccggccttctttgcaaaatcctcggtccgctttgttgctccgatatcaggggctacgagttgatattgctcccactctgaacggctcagtaggccaccgaagaccgaagattgacggacaacttcgacgttgttaatcaggtgcagagttgcgtcgctgtgagggtccacaacgataactcggtcatatccggcagagttcagcatgtttgcaaacactttcaaactgaaggcgtcgcccggattgcaccgacggtcttggcgagcatacgggacataacccagcagaagagtcatgtgcggattaatcatttctgctcggatcgcctcggtgacgttgagaagagccatgatatcatcactattctgaatctgagctttaacgtttacgaacgcatggctttcgatgccgcccacattaacgcccacttcgccgcccgggaacgtccacacttttgcctcttgccacggacggctcataacaccttccatttcctgaaggcaacctacagcataactaatcatacatcctcctcacagtttcacagagaagcgattccgcattgcttccatcgtgctctcgggaacatcgtgtacagacttattcccatgacgattctctacaatcagagagataacagtgtagccaaactcttcagccatgtcaatgtatggtgctacctctcgctcccgggtactagtattggatacgataaccgcatctagtcctatctccatagaccgtcgcgctttgtccatgcactttttgtgagattcaactaccctctcagctttccacacatacttgccgaactccatttggtaatcgtccgcttcgcagatagacgcctgccggcctgactcccaagttttgttatacagaatctcggcaagagaggacttcccggagcccgggagtcctcgaatgatatacatgatcttttcttgcatacttcctcctttaaattcgagccatatcgaagtaggtttcgatcagaagtcgtcgctgtgcatcggtcatttctgagaaccgagcctcatccacttcatttaccaagaagtctaccagaggatagaactcttcgtcaagcgtctgcttgaatccagccgggtcttggtacatcgcattgaccttcttactacccatcctcatgataaacttcttgccgaggtagtgagttgacttgcacttcactgtccctagccctgtttgtaccatgtaaccttctttctcacaagaactcagaagaccctttgcatgttcccagctacactctatgtgctctggacgaagaatctttacagaactgtggtccgttacacctagggcgtgagagtcaagaatatattctgaaagctggcccccagtgaagatatcgcggataccgatcaaatatgccccttcttcttcctcgacaatgtgagggtcgtctggagagcatatctcgaagttatatgtgaagcctgcgatgtaatcatctgggttattcgacacatacttctgaccaagggcaacgtaatcgccggtcaatgaccccgtagtactgaagataagggagccattgtgcttagtcacggagaacatgaatccattcactttctcaatcagccgcacacggaatttaggatggaggaaactcccagcaccattctctcccagattaaacaccttctcgaaggggcgtacaatacaatcaccggagtgctggtcaaatacatgaccccgtgcctccagaaggagcggatgctcattccacaggttctcgtagaacaccttccgggcatactttataatcgacataccgttgaagtgcttaacagtcaccagcttattagcgatcaggtctttgtacattgcaatgttgagattaccttccatcctacttctccttatttcaattcgacaattgggcagaatttagccttctttgcctttagatacgataccagaatcccatccttgctggacgatttactcgacataaagcgagagaatcggtagaaaacccacacgccataaaagacggctatgattccaatccatacaaaccccatgacagccagagtcccacctagaacatatccggtaagtggaccgagagccagagaatacaatacagagcctacaacagcagcgagcgctacaaccgttaacgccagccacacgacgaggaatactgtctgccagaaataagagcagagggttacaatttgccaaccgcttgagatagccgaatagaccggggtctcgaacgtacgatggagccgcatatgccacgaattcttatcaatcttcatgcttgttcctccgggaagatgttgaagttaagtacgttatgctcttcaagttccatggaggctaccatcttataacctccgagcttgtgaacgatctccagtatactctcaatagagaatttgtcaacatgctgcttcatcagattggagattcggctctgatgggttccacaccgctctgccacttcccgttgagtcagcccagactgagtgatgtagtgtgcagcaacaaccattacagttttcttgaaatccttgaccggatcattcatgttagtcctccttattgctcagcgttactttgccatcgaatactcggaattgagcgatctcaaactgatccgtccagcgggcgtcctcgaaagccactccttcaaaagtcccgtcttgtttaacatcagaagtcatgaggacgataaaaggaactccgtcgtcatggatcagttccaccagagtgttagctttaggtttaacatcctccttgtcacgcgaaatcaacacattgaccattctttcctccttttatttatggtggtctacaaccacaaactcttgctctcgcatatattccctcacttcgtcgtaagagaatacctgatgatctgggtgattgtcaatacctacatcaagcctctttcctttggaaggcaagctgccgtgagtgtggccgtgtagatgccaagcaccatgatgagcagtattccacgtctcgaaagggtagtggcacatcacgatcttcactccgtcaattcgaatctccttgtactcacgaatgtcttctacgtgagagagattgctagcagcgatcaacttccacagacgagagtcgcaatggtttcccttcaggaaggtgatacggccattcaactgtttaatgatctccagtacagagtgcagcttgttcctgccggcgaatgcgaagtcgcccaagtgatacacttcgtcaaaaagtcctacccgggagttccaccgagaaataagctcctcagtttgctcctcgaaagtccaaggcctgttgcagtattcgatcacattcttatggaagaagtggagatcggaagagaaaaatacagacattatgcctccttttcaaattcataaatcttgttgatcctgcggatcagtcgaatagcagcgcctcccagcagatgctctcgatccggtttcatatgggccattgccttgaactctgacagcatatctcggcgttcatagtggaagtctactacccagtaggtgtctgcattaatcttaccctctcggtacaggtgcccttcaacaccaagccagtggtctactgcgtctttcttcagaagctccttcggagaccacttgtctacaccccgcaacttctcgaagaaagagtaaggacgaaaatagttgttgatggcttcctctacagccgactcagcctgcaatttaatgaactcccatcttgcaagaacttctttaatctcctcggtggtgaccggggtgtagctgtactgctctttatattcattccacactgtactgttctcctacatagcctttgaatttgtcggaacgagttgtcttcttccgtgccttgttttccagaactgatgcctccctttcgagcatgctcagttggttgctatacttcttgatccgcttcgagttaccactcatcacagaatttgtaagatttgcgatagtatcgcagattttcacttctcttgcaaccggatgattacggcaagcttcgatatacttacggtagctctcagcacggttcttatcgagaatgaccaaagcctctacgatgtgaggcatcacgcccatggactccaagtcttcctctgtcaactctgtatcctccagaacgtcgtgcaggaagcacacagcgagaagagtgtccatgtacggaaggtcggagaaagcctgacccgggtccatatctttaggagcgttgcgagccacgcagactgtatgcacctgattcagatggtaagcatacgggaagttggtctctccgtaccgctgaccttcgtgagccgagagtgcgatctcaatagcgataccaagctgagtgttcatattagtctcctttgtagaatgtgtggttgcctatcttgattgtgcgcttgtatttcctagcccaccgaggaagtttgccattattagcccgtctcaccttcctctcgttgaggtagtgatcggctcctctcgttggatcgacagtatacccatatagggcgttgtatgcaacatgtttcgctgcctcccacttgtcaagctccttgacaccttgccgcatactcccatcgcaggtgtaggaatactggcacttgaagtagagcactccggctactgtgctcggccacctgtcgtgcttcattctgttcactacggtatgagctacagcaatctgaccgatctccggttctccccgggcctcgaagtatacagcttcagccaacaacctgcaaggctttctgtactcacacaaggtgcgcttgctttctatgatttgaccgggactggcttggaattccactacaggctccgtgccgtattttagacgagagtattccatgtcgaggaacatcccaatgaaggctagaaggatcgacaaaacgagagcttctaaggtttccataacacctccttagacaaagaagcccgccttgtgggcgggctgtatatcactcggctattatacttcagcccaagttgtaacgacgggcgtagtctttgttggggaactcgaccatcatcgactgaatgtgaatgttgcctttacgatccttctggattttggcatttttcacaatcttactagcctgcgcctttgccataagctctggacttacaaccagatcgatgaattctgcactccgatacccggcaccagccggggcccagaagccgtactgggtcaccgtcgatgtaggtacaaggtacaggttgtgcagacgcacagcagtgttgaaactcagcttgctgatgtgcttcgcttcccgagtttgggtttcaaaacacccagtcgtgtagttgaatttgtaagtgagagcatccatgaactgaatgacgcttcgaatctggatagcagaagtatccaagagctggaactcctcagccgcgtcgattgcagtggtcacgttgacagacttagcgttgaacattttatatcctccttattcttcagggacaaatacaccgccgattacccggccagcgcgaattagtttaccagttgggaactgagcacgcaaggtctttttgaaacgactttgaatttgcacagttagccacttaccccggtagttctcaaaattagtgatctgatccttgcgttcgtcaaagtcaccgtacgtcacctcaagcagctcttgaggtacagggtcaaacaccaccagaacagcgttcccattcttgtctaccacgtagttcacgatctgcatttccatatcgaagaactctttgtacttctggagaccactagaacgtttacctgattcgtacagtccttcaggactccgccacatgataccttcatagcctttctgtcgatacacatcatgaagacgtttcagttcttcaaaggtggagcagaatacgtactcgacgaagcgaattttaccgatcccggcaacagtcgcagccttgaactggaagtctaccagacgctccttgaatgtcaagccttctttcacgatatcgaatacgtgaaattccatccgcttacgaagaccgtaaataaaggacgtgctgtccacttcattcaggagacgatcatactcctcctctccgttctctagagcgtaggcgtcaagagccttctcagccttcatccacttatcgtaggcatcctctcgcttgaccgccgagttgatatcctccagcacctcaccgtggacgtacagttcgccgtcccacacatcaccctcttgcatgatctcttcgagttctttgatgatgtgcggtacattgtaaggtttacccatgcgagacgctagcgtaactacgccattggctttcttagccatgcaacgcaggccgtctagtttaggagagccatacccctctttgtatttagcgggatcaagcggttttgcgagcatagccataacagggagatcgttgagttcttccttggctgcacgataacccttgtccaactgcttgctcaccttggactgagcctcagacacggcctgctcctctacagagcgtttctgcttaccaactcggatgttggtaacctgagaggtcatggctccatgttctttgccgtatttcacgacgatattgaagctaccgtcttcctctccaaccacctctacagtccactccttgaacccgcctttcttgtcgagcccatatagtcgttgaaaataactcattgatcctcctcgtatttgatgacaagaacatcattctcccgtaggtgcctaagaccctcgtcgagccgatattcgtgcttatagtacactactttgatcccagcttcaaccaccgagatagcacaatttttacagcaagagtgagtgacgaacagggtagccccttgggcactctcagggctgcgtataagagccctcagtgcgttttcttcggcatgcctcacctctgccttggttactcccgtttcgtcctccagcggcccgtttaggtgctctggaagggcattatacccgcaactgatgatacggttacgttttactagaactgcaccaaccttggaacgagtcgagtcgctgcacttagcgaaggcctcagcggcctccatgtaagctttaatatgcttgaccttcacgactagcctccaattagaaccgcgatctcctcgtagtacccctcttcagggcacgcgaattccatgtagtactcgtcagtgtctgtcaaatagacaacgctaggcgggtaatagctccaagtcgggtctccgtgttcaatctccgctaccttcaagttgccatacacagtgcgaagagtctgtagagcctcgatcacatcgtcgatgcgcattacagtgggttcagtcggttcagtcatatctcctccttagttttctactttacaaacggcatcgccccggcgaaggaacacttgcactgatggctttccgctccacttgtcccacgcttcagctttaacactgacagtcttaggattgattgcaaccacctcgcctaccagcataaccattccagttccgcctaggcagaatgctactgcgtcgccgatctcgatatcccttcctgctacgtccttcatttgtactctccatctgcacccttgattaaaataacgaagtccgagggatcatcactgccgtaggcctttgcccgaaactcctgctcgtatttattcaccgcctccggatcacttttaacctcaagctcttggtagaggtcttccataaaccaacccaagtccgtggtcgcagccgaagccgagaggtgaccaagaagtcctaccagcatattgatctcgtcgctctccaactccaacttgtgaccgttacgttttactactttcatatttcctcctatcgcttctgtccgcttacgtcaaagtacgatttccattcttctccgaatagttctctacccttatcatcgtagactttatgagcctcttctgctgttttatagcaaccgaggtaaattctcttaccttcatacctgatccgggcaacgtacctgttgtttctaaaaaagataccgggatacccgtttgtattacgggtagacgcgggtttattctgctgctgctccgagtccgtcgcccaccggcaattagacttgcaatacccttttgtcgagtcctttctatcgagagtctttttctcgggtcgttctcccatgtcctcatagaacccctcgaatgtcttccacttaggatcgatggtaacatccttataatatttgtaactcttgtgctttgggttcgtacatctgtcgatcattgtcctccaagaattgtatgtcggagttccgtacattccatgggaggatagtagtttagactgcatgcacccgcaactcttattatctcctaccttgagtgctccagttctaattttcaaaattgccccgcagatgcattcgcatagccaaagaacctctcttgaattactcctcgctccagagtctccgactaccctgagatatgtgaatgtctgccctgtcaggtctttaactgccatcttacctccttacttgacgagtggctacgccgtaagctggcttgctcccctcgcccgtgttgtgtttcttctgcactcggctggcattgacggtgtaacgccctttgccatactcttcatctatccacgcttgggccttagctcgctgagacgtgtggacaaagatgtagtagccagatgcatccttgataaaccaagtggccgggggctggaagtccagacgtgaaaactcttcatagtcgatcacagtcaccttctgcttagccactgtatactgccccactaccgactcttttgcaatgattttatcaatcatctgagttgaaagatcagagttcttcgaggtcaatttctacctcctttcctagtccagtatctgcaaagaagctatcgagactcagagcgtggtattgagacactttgtaaccaccactcttcagaaggctgtgagcggcctcctctactttgtcctctgtcagtctccagtccgcacctaggagtacttcagctaactgctctacacttggagggttcccaatccacagacccattctactgtcaggctcgtaatcttcttcccatacaagttcccacactaggttactcattggtacacctccttcttacgaatagaatacataacccactcgtcttttcctgtcttcccgcacggaatgtctacttcacactctgcgtttacaatcaggcccgctacgatgaaatcaagaagctcctcgtctggttctggcaagcccgggtaggacgatacaaccctgcggatagtctccgctttggtattgcccagtaccccaagcatgtggagatcgaactctccactgtagtcgtcccagagttgtccaaatatcacccatacactattcatacctagtaatcctccttcagcttgttggtgtccattaggcagcctccttcttcttgtccagcaacttaaggcatcgtttgcaggtgatatgattgcggtagcgggagaagttcttctcctcgaagtcgccatcggtgccacagaagacgtcatacggttcttcactgtccgcttctgtgccgccgtcccactcgtcgtagtgaactgttcgcgtcgccattcacttcacctcgattccggcttgctggagggcttctttcacggcatcaagcactgcgttgtagctgccgattatcaggttgccgtagatgtttcttgtgggctccattttctccggcaactccaccctcagagccgcgcggctggcttgccatatccgccagtcatgatgtggtgtgtcgtggatgtattgatgcggcggatgctcatatcgatcaagggtgaagccatggtgcccatccttaatttgtgccgcgtagttacgcacgaaccacgcttcaaactcgtctctcatactccgcaatcctcctgaatctcttttagcagctcggaaggcataaccgacagcgccagttcctccagagcatggatgtaatcctcaacatatttccactcctttctgatcttctgaaggtacacgccttctttactgttgtcaatagcctgaccctccaactcctgcataagttcgaacatcttgtatatcctcctttggccgaaaaaatggccggcgactactgtcccggcctgatgatactactctgaaatttcttccattgcaaggcgtttcttttcaaagaagtcactgagcttatcttctagctcttcgccaccaatgtaaagctcttcccctgccttgacacgctctagctccttctcagtcaagaagtcactgtagacgtgatctacccatttatcgcaccacgctgagctaaacgctgcattcctcagactattcctgaaatcagcagatacaacgccaaaagaaggcgcgtggatcatgaaatatgtgaactggtcgatctcaacggagtcgcaggctagcgcgatggcagtcatggcagacgcacactcaccttcgagacgagcatgcactggagcttgacactccttgatcgctcggattatagcgttggcggtctctacctgtccaccgcatccgttaatggtgatgtacacttcatcattctgacctgcattttcaagggtccaaagctcctctgtgagttcttcgaggctcttgattacgtatggcagaaggatggagtaacgattgctaacactttgtgtacatgaaacaggcataatacctcctttacaaaaatgggcccgaaagggcccttattactgaatcactcctcgctttctttctggccagagcccagcattgcaaagaatggaaggaggattgtgctcagctctccgctgacagcttcaccaacttctgcaccagcctgagctacactcaggaattcttcagtgcgtacaaacttgtcaaccttgacgagggttttaaagtctactcgttccaagaacgcagtcccggctgcttccgctagaggttcgaggtttacgacttccatagcgcgatccagagcttcctgattgatctctaggccgttctgggctgcaacctgcatcagggtagacttcacagtctggattgcgtagtctttgaaaaactcacgttgtgctttgttaaacttcattcacttttctcctttgtagtacgacgacggcgggtttttggtttatcttccgattcagtctcttggacttcctctacaggagcttccttagctacttctgtagacttttcctcagtctgcttctctgcgccttctcggaccatcttgacagacttgagagcgaaattcatattggcgaaatgagggtcttcgagatcaatgcggaaaccttgatcgaaagcattttgcatgcccatcagaaggctgaaaacgtcccattcttgcacaatgacctcattgccgtcaagctctttttcaatctcagggctgacgccttcctgccggaacatctgcacttgacagagggtaccgtacacaggatagccttcaatcgaccgaacgacacggaaaccttctttcatgtgagcatgaatcgaacgaagccagacgatagggttgtattctacaatgttgataacttgcatattcttttactccttgcgggttagtgttttacaataataccacgtttctcaggaatgtcaacccattttgttctggtaaaggcttgacatagaggaaatctgtggtattatcaatattcagcgtgggagagatatgtctgaaagcactcaccggcccacgcctagcgcctatgaagaggaatccacaagggcaacctgaactcgaatgctgttaaagggtggagacgacgcgaaagcggaatgacagcaatccgatgcagcctacatgctgcccctcaccgaactcatctgcatgagtaagaggaattggatagagccaaggcacgtcttaggcagattaaattctgtatggcgagccttgggacgactctatccttccctagccgaatctatctgcatggggtgttctcctgatacacatacacaaatacccaccacagataatccatcaatcaacccataaggaatttctatgagatgtaagtgctgtgatagcgaactctcgtttgagactccagtcatcaataaacatactggtaaggaagacgatctatgctcctcttgccgtaggtttgctctcaatcctacactggatcatgagtattttggtggttggtatccaagcgaaggggttaccgctcctctgccgaccggggactgacattgtatatagagtgcgcgtactctgacaatacatataaataatagattacggtgcgaataattctttaagggcttgacaacaggagatttcgtgctataatcggagtatatggggcttacaaagcttcagaggatttaatatgactcaagaaagaaacaagggcggtcgccctacgaatgccgagctagaagcccggggtatcattcaaacagacctaaaagcaggactcagacttctaaagaagagctttgcagagaacattaggttcctacaagagcaatctgataatcctgaggtttctctacaaatgagaatcaagctcaagaaagagctttctgatatgttcgtcgcttactacaaagctgacattgcactcaaaaaagagcttgcaaaaggaacagaatcaggagataatgagaacactgaagaggacaagactcccggagtagttctcgcgttttgattaattgccgcttcgttcaatggtaggacgccagactttgaatctggagatgatggttcgatcccatcagtggctgccaaatgtagtaaaagaacattcacccgacaaggaatgtgtctcgctcagaggacagcgagtaataagtgtcctccagaattaagggtcggtgagcgtaattggcaacctactggattccaaatcctcgtattctctgttcgaatcggagtcggcccgccaaattagtgttgacaggagcaaagacctcttgtatagttacaccaactgctcgtatagtgtaatggacagcacaacggtcttctaagccgtaaggtctaggttcgaatcctagtatgagcgccaaattagatggacggaagctaaagtggataggcatctggcttttaaccagatttatagtgagttcgagtctcacccgttcaaccaattttagtgagtaaatcagataggttctgaggctccctgctaaggagtacgtctgctaacgcggatgtggatcgagaccactgctcactgccaaaaataagtgattttaagtgttgacaaactgaatttttcatgttttaatacacttatcagatgaagaaacaattagcgagtagccctgagtaggtcgggaactagtctagaaaactaggccactgcgatgagcggtgagggttcaactcctttactcgctgccaaattaaggccctgtggtggaattggtatacacatcagtcttagaaactgacgccgagaggattgagggttcaagtccctccggggccaccaaattaagaatctcttttgctatttggtaagggttcgagtcccttcccggctggatggtcggtctacggtggccaaatagtgagagagctaggggacatgacgaaggtagcgctgctttccgatctccccggcgctataaaagttatcatgaaggggttgacaaacaagaaattcatgataatataggtacatagagtaacaaacaatatggccagatagctcaattggtagagcacccgaccgataatcgggtggttgaaggttcaagtccttctctggccaccaaaatttataggcccattagctcagtctggactagagcaagcccctgtctagggcaaggtcgccggttcgaatccggcatgggtcgccaacaaggtcgttgtagagatagatggctactatcatccggctgtaacccggacgccataggctagaggttcaattccttccttcgaccaccaaatagcgagagcgttaagactggctggagctgtcactcggctcataaccgagcacaagtggttcgattccacctctcgctacaaaattgcactccgaggaaccctaagtggtgggttcagtgtcgctacctatctcggtaaggggaagcgcctaagctggcacgggtaattgagtagctgtgataagctactggcagccagtataaatcgtccggctcgggcccgttatagctcctagatttgaattagatgctgtaagccataggaggtgatccagtatctcccggaggggcccgggttaacaacctcatgaatttagcccgcgttggccgagaggtttaggcggcggattgcaaatccgtctcacatcggttcaaatccgatacgcggctccaaggtttatattgggatgtagctcagttggtagagcagggagctgttaactctcaggtcgcaggttcgagccctgccgtcccagccaatttacaaaagagactcttcgctttagaagcagagtcgaacgcccgttacgggccttattcatctcctcgtagctcagtctggttagagtgtctgatttggaatcagaaggtcgaaggttcaaatccttccggggtgaccaattaaagcgggtatagctcagttggtagagcgtctgccttccaagcagttcgtcgtcggttcgagtccgtctatccgctccaaacaatgcatttgaagctaactaggtagaagcgctgggttgaaattccagaggacttggatcgttaccaagcagatgcaccaaatagcgcagttatagattaaacggttaaatcgccagactttcaatctggtgttccgggttcgatccccggtaactgctccaatcaagtccaagccggaacattcctccgtatgtgctttcagccggcttggcattattcgtgtggagattgtgtagcccggatgctgcctttcggttgtgacccgattgttggggttcgagtccccgcctccaaccaatgtcgtgcaatggtatatcgcgttgacgcttttaggctctctggatcgtaagccagtaaagcgagaatagcgggctctcgcagcagagcgataggtggttcgattccacaacatgacactctttcctcctcgcctgtgctgaacggtttcctcctcctttcccgtctcacaggctctattccctgccctttaagcatttatggtgatgcaccggctttgtaacccggcgaattctgttcaagtcaggaatggggcaccaattcactatcaaagaacccgcaagctcccgatagggttcacactctataaggttgtagcatggaaaacactaaggttcctgataaaaaactcggaccaatcgcgctagcgcttaaagaggccagagagaatttcgatctcagccctcatgttattggtccaaaatctttcaaacagaaagagttcacagacagcgatgcaaagatcactgtattcggtggtgctgctggtgctggtaagtcttatctcggtgtaatggacttcatgaaatatatccatgatcctaacttccgaggtgtaatgactcgtcgtactactcctcagattaaaggcccgggcggtctgcttgaaaaagcaacagacctattcaagctcgttgaccctaaagtcaagtggaaagacaaagacggcaagtttgtgttctcttctggtgcagttattttccttcgacacttcgaacaagaatctgacaaagactccttccaaggttgggaggttagtaagttcctagtcgacgaaggtcagcagttcacagaaggcatggtgacataccttatctctcgtatgcgtaacccgaaatgctcggttgttccgcacatgaagattacatgtaaccctgattacaattcgttccttcgtaaatggattgaatggtggctagaccctgacacaggaatcccgatccctgagcgctccggcgtaactcgctggtttgtacgcaaaggcggtaagatgttctggggagacaccaaggaagagtgcattgcccttcatggtaatcccagtctagcgcctgacgatgaagatcaggtgaagcctatcagcttcaaattcatcgcggctaactgtttcgataacccaatcttgatgctcaacgaccctgagtatgtagctaaccttgaagcccttcctagggtagaacgtgaaaagctcctagacggtagctggcacgctagagaagagggagctggatacttcacaagggactggtgccaaatcgttccccacccgcctctacgggtgcttaaaagggtacgtgcatgggatatcagcggtagcatcgaatccgaaaccaacagaaaccccgactggacagccggcgtgctgatgagccgtacaaaagaaggcttgttcactgtcgaggatgttgtcagagagcgtaggttgttcggaggtgttttcgacctcattctagaaacagccaagcaagacggtcaagacgttgaaattcaaatcccatgtgacccgggggctgctggtaaagcttatgctgcccagctaattagagacctagcggatcatggattccacgccagaccgaagacaactaacaaatcgaaagttactcgattcgccccgttcgtatctgtagctgaaactaaatcagtgcaagtcgttgcgggagattggaacgaagattacttcgatgaacttgagcgattcgacggaagtaaggctatcaaagatgaccaagttgacgctacatcagatgcatttaatgctctatcccttggcagcttgattatccctgatttcctaccgcctgatatgactcaatccaacaaattcaaactaaattaataggaggcggcgatggccgagactgaaaaaacagcaccgggtatcccgcgacttcgcctaggcgagattggtagtacaggccttaaacaagtcaatggtactattctggaagaacgccgaccagaacttcggttccctagggcatgcagaacattccaaatgatggcggaagaccctaccatcaaatcagcactcgatctcttcgaaatgatgatgagcagggttgactgggaagttgatctaggagttgaccccgacgaggctatgaaggcccggggtaaattcctgaaagagtgcatgcatgacatggaacacagttggtactccttcatcaaagaggtcactagcttctacacctacggattctccgtacatgaaatggtgtttaagcgacgtgaaggataccctgtatcgaagtacaatgacaacaaattcggtattaaaaagttgccaatccgctctcagtctactatcaccaaatggttgtactctgaagacggtagaaacttcctagggtgtgagcaaagtcttgccaatgttgtcaatggcgaccgttacgtcaacctaggtaataaggacggaactgtagagattccagctaagaagatgcttcttttccgggtcgatgctaaacgtgacagtcctgaaggtaacagccctctccgtgcgtgctataacgcttggagatatcgagtagagattgaagagcaagagtccgttggcgtaacacgcgatatgaacggtatgcctacgctctatctgcctcctcgatatatgtccgaagatgctacagaagctgagagggcagtctacgaatactacaagcgagtaattcgtaacattcaaatgaatgaacaatctggacttatccttcctcaagcgtttgacccagaaagccgacaacctctgttcaaattcgaactgacctcttcgcagggcagtaagatgtatgatacagatgccatcattcgtcgctgggacaacaaaattctgcaagccttgtttgccgatatgctgaagatgggtcaggaccaagttggctcttactctctagctggtgccaagactaacatcatggctatggcgattgaatcgcggctccgcgaaatcaaagacgtactagataataaactcattcctacgctgttcgcactgaacggtgattatagtccagacttgccgaagctgcaatacggtgagctagatgaaatcgatcttgaagagttctcgaaagggattcagagaatcggttctgtcggtggtcttgaacgtgaccgtgaggtttacaacaagattcgcaaagctctcaagattaagcctcgaccagacgacgagcctgttgatgtggataatatcatgggtggtcagtctcaagcaggtaaagctggagtaggtaatggtgcatcaacatccgcagccggtagagacaacgccgctgcaaataacgcataaggagacagaatgctgactcttgaaagtgttattgaagctctcagcaatgctttcggggctcccgccaaggcggaagaagccccggctgtagaggtcacaaagtccctagacaatgaaaagaggatggctttgtttgtcgttcttgagccccaagaaggcgactccacgactgacctacacgcagacacctactccgaagaggaagtagagaaagcttgcatcaacttcaatactcattgcaacgtagctaatatcttccacaagattgaaacacaggaagctgagattgtccagtccttcatcgctccatccgcattcacaactgacgacggaagagagatcaagaaaggtacatggctccagtggtggcacttccctgaaggctctgaagtagccgatgcactatgggaaggcgttaaatctggtgaattcacaggcgtctctatcggtgccagagctacagtcgaggatatcgaatgaccgtaaaagcaaaacgtaaactgaccgatatcaagtttgaacacgaaggtgctcatgtcgctctggtcagtaagctccaaggtggtgcagccaacgggcacactactctaatcacaaaagctaccaatggcgtaactgaagagcttatcgataaagctgctgaagttacagtcacaatgcagttccctgagttccttcgtaagttcttcgggatgtattatgaagatgccgaagttctctctgttgccatgggatatggcagaacggagtatccagaactagatcacaaagactggatcgaccagcgggtcgagtctatgtccattcttaagtcggtttataaatcggctgacctgaatcaagctctctccgagcttacccctgagcagaccctttcccttaaacaggatcaggaactgcttgaaaaggctctggaggtagtctccgagcaatccaatgaaaatccatccaaggagattaccaacatggaaactatcctgaaatcggcccacctagaagctctagctgacgctattgcagttgaaaaagctgctggtgtcgctgctgttgcagaagttcagaagcaactagacgccgctaatgtagagcttacagctcttcgtgaaattgtcaaggctgctgaggcagagaaaaccgctgctatcgctaaagcccgtaaagagcaactggctgaagtcctcccggctgaccaagtagaagatactttcaagtctctggaagttctggacgatcaagcttttgcacaaacagtaggaacgctccgcattcttaaagctgctgctgaccaaaatgacatgcttgtcgagaaaggtgtatcgggcgctggggaagaagacgactctgttgtcgccggtgttgccgctatcctgaaagctcgccacggctccaagtaatatctagccaatctagaggaattccaaatggctcaaaacattatcgcaaaagatcatcagcgtcttagcaactggctgaaagaagaacaaatgggccaccgtggcctgttctacactcgcgaaactctgcctgtcgctgacattgatgttaaaacaactggttctgtcctagacagcactggcaagctggtaactaaggctactatcgccgacgctacctacatcctaattaccgacctgcacgactatgccaacgctcagatgagccacgctgtcgtccttgctcgcggttttgccaagatcggctccaaggctgttatcttcggtgctgacgttgacgacgctgataaagctaccgtctttgaagctttcaaagccaagaacatcttcgccgttgaccagatcgaaggcgcattcgagaacgtcaccttcgcgtaagcgagggtcgttccagtaaataaacactaggagtaactttaaaatggctaacacccgttcctacctaaacgatggtcagttctacattgccgaccagactgaaaacctgcttatcatcccgaacacttggaccctcgtcgagaacatgggcgtcttcacaagtgaaggtgtgactcagaacactgtccagttcgaagagatcgaaactcgctacggtctggttaaggatgccatccgtggaactcgtcaccaagttgctagcgaccaacgtcgtcaactgcgtgccttcgcgattccgcacttcaaccaagacgactacatcactccagaagacattcaaggcaagcgcgctttcggtgctgaccgcgaagaaactctgaacgaggttcgtgctcgtaagctggaaaccatccgtcgcaactgggctaacaccgctgaagttgcttccgttagcgctatcgtaacaggtaagagctacgccccagccggaaccatcgagtacgactggtacgacctgatgggtaaaactcgtaaggttgtcggcttcgacctgaccaaccctaccgctgacgttatgggcaagaccgaagaaatcttcgtccatatgcaagacaacagccaagacggtctgatccgtggtgacttcgttgccctgtgctctcctgagttcttcactgccctgattaaccatccgagcatcaaagagttctacaaagcttaccaagctagtcctcaatactggcgtgaacgtctaaccgctcgcggtctggaccttcgcttccgtgagttctacttcggaaacattcacttcatcgaataccgtggcgttgacccgtacggcaaccgtctgatcccggctggcgatgcttacttcatcccaaccgacagcggtgacctgttcgctcgttacttcggcccgggcagcactttcgatgacctaggaactctgggtaaagaactgtacgctaccgagcgtatggctgaagaccgtcgttcgatcctgatcgaaaccgagtccaacttcatccacgttctgcgtcgtccacagatgatcgttcgcggcactgtgaatgcgtaaagacttcagggaggcttcggcctccctttcgtcgtaggagggtaccaaaaatggcttacactggtgatccagcaaacaaccctatcgaccgtctacgagagattgtaggggacgtgtgggagcctccgatgctttccgacgaaacctatcaatgggtgttggacaagaacgaaggcaacgaaagacgagccgcacttgaacttatgcgtatgatgctcttccgcctgacaaggggaatgagagaacgcacaggtgatatcgaagtatatggtgctgagtatttcaacaactacttgaaagctcttcagctcattctcaaagacccgaatattacaatttctttggccgtgccatatgctggcggtatctccaaatcggatatgctggctaatgacctagaccccgacaacgtaacacgggaattctacatcggttttgcaagacgggagaagctttacaaccagtgcaaccccggtcctcaagaccttagcatggggtgtgattatcttggcaagcttcagttttaaaacagatcgccgtcgcctcacatccttgattaagagggtggaggctctagacggaacaacggtagaagttggtttcttccccgaggaccgatatggttctgaaaatggaaacctaccagttgcacaagttgcagcttacaacgaattcggtactactcgcaacccaacccggccattcatggctccaacctttgaagaattcacatctcaattccactacgcaagactaatgaagtccacgttcgagaacgtcctacgcgatggaaggcagacgaatactcttctgaagaaattgggtaaaatggttgcagagcagatgcaagttaacattgacgactatccgggctctaacagtccggcatgggcagcttacaaaggatttaacgatcctctattccatactggaaagatgcttgagtctgtcaagttccaaatccatcggaggcaataatgctctatcctaccttctccatgaccaactttgtcaagctagatttgattagaagagggcagcccggagacgacggttttggaagacctacccctccagttgagacagtagtaacaatcacagctaacgttcaacctatcgaaaaatcgacagacactcgtatccttccagaggccgacagaagcaaggctcgcttcaaggtgtactccagaggcgaagagattcgccagttaaaggaaggcccgggagggtggagtgccgatagattcatgtgggaaggggagttgtatgaagttatgaaagtcatcaactattcgatgggaatcctaaaccattacaaagcaatttgtatgagagtagagaggaatagcacagcatgatccacacagagctagaaaactccctctatcttatggtcaaagagttgttccccgactggcgtgtaattcaagcttacacgaataatcaggaaccgcaaaccccttatctggctatcgacattaagaggctggatgaactgggaagggaaaatgtctccaatatgagcgatcccattagtccttcgcatggaactattcaagttcaacaggacttcgcagccaaagtcgtattcgaactgattggcaagtatggagagacagcaagtgtctctgacatggcaatggcgattactcgggcaatgcgtactccagcaggacacgccgcccaaagaaagtttaatctatcccttttcaaactccctagcacaagacgagttcctatgctaagagaaacagatatgtacatgttctatcaagttacatgtgaatttggattctctgtgacagaaaccacaactcaagagtttgctgctggggctgatattcacggcgtttattacgacgctggtcgcccgggtcacattattgagtcccacatcgacataaacttcgaacactaataggagacaggaatgactgttcttactgatgtaattgacattcagatcagccgtgagactgctgctgtcgcacagacaaacttcaacgttcctctgttcatcgcttctcacacaaacttctcggaacgtgccagagtctacaacagcctgaaaggtgtcgctgaagacttcggagagtccgatccaacatatcttgccgctgttcgctacttcggtcaagctctcaagcctcgcagtctagttatcggacgcagacaagttccttctgctaccgtctctgtcagtgttgttcaggaaggacaaagctacgtccttaccgttaacggactacctgtcagctatgttagccagcaagacgacactgctactctgattgccacaggcctaaaggcagcttatgacgtaactccggtagccggcgtaaccgtcacagacaacgaagacggaactctaaccgtcgcttctaacgaagactggagcctgaaggtttcttctaacctgactatggctgctgctccctctactgaaggttggccggctgctatcacagcagttcaaggagaaaacgacgaatggtatgctctgagcattgacagccacgccgatgatgatatcatggcagtagctactcatatcgagggcaccaagaaagtgtttatcggagccactgctcaggctaacaccaagacttccgcagagaatgacattgcttctcgtctggttgctgccgggttccaacgtacggctctaatttaccatccaaacgctgacgctcaattccctgagtgtgcttgggtagggtaccaactgcaagagcaaccgggtagcaacacatggacccataaagctctggccgctgtagacgcctaccgtctgactccaaccgagtctaccaacctgaagaacaagaaagttaccacgttcgagcgtgttggtggtgtcaaccgtacattcggtggggctatggccggtggtgaatggattgacgtaatgatcttcgtagattggctggaagcccgcatgaccgagcgtctgtggttccgcatggccaactccaagaaaatcccttacgactctgttggtgcaacaattctggaatcggaaatcagagcccagcttaacgaaggaattcgtgttggtggtctggctgaagctccagctcctaaagtcttcgtacctgatgttctatccatgtctccgaacatgagagcacagcgtatcttcgaaggcatcgagtttgaagcccgtctagcaggcgcgattcactttgtacacatccgagggaccgtgactgtataagtctggtccttcccataaggagactcataaatggctgttcaacgtctagctacattctctccagccgatgttaccattgtcatcactcaccctgcaactggtgagagcatggttctcggcggattcagcgaagacagtatcgttaacattgaaagaaacgctgacacttacgtgatgtataccggagccgacaacacatcgactcgcgtctacaacgcctctaagtctgctactctaactgttagccttcaacaaacttcgccttcgaacgacttcctgactgctctttacaactacgacgacgcccgtcgttcgtctgagggattgttcacaatccacgttaaagacaactctggtcgttccgactacttcagtgatgacgcctatgtcggtgttgttccgggttctaacttctcgaacagcatgcagacacgcgattgggttattcatgcacacaacctgcaaactctaatcggcggtaacgccaagctgagcccgggtgatgcggatactcttcgtaacctaggtgtcacactagaccagcgctggctgtaatatagcgcttatgccacatcgacggggagctgccttaacgggtggctccctttgttgtttctggaggatagaaattgattaccacctactcgccgcgtgacgtggttgtaactctcgctggtatccattccgtgacagggtacgcagagggagagtttatcaggattgtaaaagatattaagcctttcatcaagcacggttcgatggatggtgaaatcgcaagggtctacaacaaagaccaaggctggcgagtagagttgacaatcatgcaatcctcgccgaccaatgatatcctttcgatgctttacaacgtggacattgcaacccgaatgggaaaattcccactgatgattaaggacacgaagggttctacaagcttcctagctctgacagcatgggtggaagacctacctagggtatctttctctggacaactggagacccgcacttggattctagggtgctctgaggtcgccatgaacattggcggaaacgtcgatcaaagtttggtcgagcaagctatcctgctgggaagctctcttctgccagcccttacgcaattcggaggcttctaatggctaacacggtattgacatatagcccatctgatgttaaaattgtcctttgtgggtatgctctcactggtgtagtttctttcgaaatgtcttggctttcgagaccctacacaatggttcgaggaatcagagggcaccacacccgggtcttcaatagagacctttctgcgcagattagaatcgaggttcttcagacttcggtgtctaatgatgcattcttctcgctagtagagcaagaccgaagaacacaatccgcccgaatcaccttgtctgtcaaggatacccacggtagcaccatgatgagcacagacaacgcttatgtcaatggctaccctagcataacattcaccgatggaatcgagaacagggtctggactattgatgttctggactggaccgatggcacggtaggcggaaaccagcaagtcggcttcgacgtgtttggaactgttcaaggcgctcttagctacctcagataaataaggagtatttatgttcggaaaccaacgtactgtcatccacaatgggacagaatacactatcaaccttctgccagcaactcgcggtatcagcgtactgaagcagctaaccagcttgctgggtccatcccttgccaagtatcaagctgaccacgacttctctggagccatgaaagaactgttcgataacatcgacaaggttcctgttgagaatttgatccagaatctgatgctgacagttttcaaaggttcgatggcaatcaatttcgacaccgaattcgctggcaagtatgacctgctgtacgcactcacaaaagacgtgatcgagttcaacttcggctcggttttttctctaatcggtttcgcagaggcaccgacggtataaagaccggggatgggcagtccgagacttcagtcactactgatcgagttcagagtgatcggagggttagggaggcccaccagaagttctcgcagcattgggagatttatgtggctatcactcaccctctcaagctaacgacgtatggggaactgagtacagtcctcactacagaagatttgtacaacatccttgaggttatagacgttcacgatactatcactcaagtggcaaaagaacacgcagaggctgataagaaatgattacagaaaggattgcccagctaactggggaacttaaatttacagtcgattcccggcctctcactgcttttgacaagaagctcgctggggtcgaagcccggctaagagaattctccaagctgacgaacaagcggtttggagttaagctaactctagatacaaaaactctgagagaggagcttgccaaggcagccactcaaagggtagtcttgaagaacatcgcggtagatgctgccgctgttcgtcttatctctgagaagcttcaagaaagactgaatgcaacgccgatcaggttgaagtctgttaggctagaccttagcggtatccgagatcagaaaaacttcgtaaagacggctctcggccagaccaaggtcgatctaccggttgaactgggcttggctcaggctagccgtacgctgtatgaatggaagaagcgcacagagagtcgttttaaaattcatctgaatgcagacattagccgctctaaattgctccagaatgcacgaaacacactaagggatgtgcagggtaggctaaacggtcttgctgtcgctacgcctcaaattaggctgtctgtagaccgtgcccatcttcgtagagagattcaagatgttcttgagcaaatcagacgcgaagtgagaatccgcattgacctagagtcttccatccgaggaggtggtgcaggtggatcgagaggtacttccggccatatccgtcaaggtatgggaatggggattggtagcgagctagccgggtggggacgcgggtttattcccggccttggtggtgcgttcgctattatgcagcttaaccgtgcaaaccaagaacttcaaggtcagcgcctagcgatgcaagctgtcggaggcggagtacaaggtggccaagaactgcaagctaccctccgtgatatctctcaacgcctaggtctcgacgacagagcccttggtagctcctatgttaagatgatggctgctggacaggcatcggatttcagcaaggaacaagttgacagcatcttccagtctatggctgaatatggtcgagtgatgggccttgacggcgaagcgatgaaaggctctttccgagcggttgagcagatgatgggtaaagggcagattatgtccgaagaattgaaaggtcagttggccgaaagattccccgctgctgtagctctgatggccaagtctcaagacatgactatcgcggaactgatgaaaacgatggaagacgggaagcttaaaagtgatgccctgattccatttgccagaactctcgctgaagaagcccgtaaaggtggcgctttggacgcggctatgcaaggtacagccgctcagcagggccgattccagttcggatggaaccgcactatcgaggccttcgcggctggaggattcgaccgaggaatgagcgacttcttcaagattgctgcccaaggcatgaaagaagcgcttcctctggtaactgcacttggtggcgggttcgaagctcttatgaggcctgtcaacgctctggtcggtattggaggggagcttggttcccagtgggagaacattgccaagcagttcaacatgaccggcacagggctgactcttaccacggctcaaaccctagccttgctgacccctatgggcaggttgatctctgctattagctggggtgcgttggcactggaagacttcattgtcttcttggaaggcggtgattcggtgttcggggacttcttgaacaacaacgtacaagctgccgagacattcgaaaagctagccagtgaatccagtgaactgaagaacaatctcgacggtatcttctctgttgtcccggggctagctgaagcgctcaaaggtctagagttcaatgaaatgctggtcagcacgatgagagaacttgctgccatcatggagttcttcaacagtgttgtagagagattcgcaatagccggcaagtacagggacgctaagattgctgaagccggaggagacagaagtactataatgtcgaacatcgacacgatgtacgctatgttcaatccggaagatgcaaaagacaaggccaccttcatcggtgacaggctagtagctcagaacattgacgcgatccagacagagactcatacccgtgcaacccagtccttgactccagaccagtttgggtatatgatgcaacgtggtcaagttagaaacgaaatggagggtgccctcaagaagagtgccattgacattagtttcaacctcaatgtttctggtatcgatgcacagggtaacgtcatgacgactgaagcgcaagagcgcgtacgagagatcgtaagcaacgtgctggaagaagaaatctccagagcttcggcaagttataaggaatcccaatgacaattgctatcaaaagagagaacggagacctaatctggttcgacgctgttacagagttcggaagacagtaccgtggctctgtgagttccaacccaatcgaaacgggaggaaaaatcacagaccacattactacagaaaacccagtcttcactcttacagccgtcgtatcagacgcagacttcaacttgaacaggcccgttatcaacgacaacgaggcccagacatacaagatcaacaacaaagagttcgtgaatacgcagccggtcagtgtgccggctgttatcacaacttctagatttgatccgagccgaattttcccggaagttattactcagtttattcctcctgagattccgtctgctactgtcctccctcaaaagggtgataaagtcgcttacgatattgagcgccaactgatcgacatgcagcgtaacgctgaggtcttcagcttgctggactttagagacggtatcatctgggatcaaattgagaggtgcatctttactgacctgtcgttcagcgagaatgctgaaacgggacagagtattcagcctagaatgactatcgaggccgtgacattcacagacactcgctacattgaagttagggtgaacaagggaagaaagacagccaagaaggaaaagagagacaccaaagatggtgatacaggggctagcaacgctactggacaagactctcccacattcaagcgtagccaaatgaaagaggctcagattagaactcaggttgcgaggtaaactaaatgagcacgacttatatcgacacacttcctttgtaccaagataggaagtatagatacgcggtagctctggagggcatttcccgtgtcctccaattttactggaatagccgctctaggcagtggcacatggacatattcgacgaggagcttaatccaatcctaacagggttggcattgattccacaatacccgataattgcagattacgcgatgcagcacatcgggtttaatgggtacttcttgctcatgcctgtcaacctagaacaggtgaagtacaagcacgatgcaagcgacattgtacctcagttttttgaacttctgtatgttaatgttgatttggaggaagatgcagagtgagacaatacgacagagtatataaattgacgctcggtaatactgagtctggtcagggagtggagattacaaaccttcatcctgatgggagtgttaacagagagggacttcagttcaggttcgatatctctaaaagctccgataacaaaaagagcggcaactcggctactgttgagatatacaatctgtcgattgcaactctaaaccttcttgaaaccgaatacctcacttgcagactagaagtggggtataaagaagctggaacttcagttgttctagatggtaatgttgtcgaaacatccacaagaaagagtggaaacgactacgtgactcagcttattcttggtgagggttacactgctctaactgagactaagctgaagggcacagtatctccgggcaaaactgtaaaggatgttatcgaagagattcgtcttcaaatgccgggagtggacagaggagcttatacaggcctcaattgcaataacccgatcatgtacggctatcaactccgtggtctggccaaagacgctctaaacagcgtgtgtgaagccaacaatattgaatggaacatcagtggaaacgttctaaacgtcacagacgttaacggaccaacaacgaagagtgttcaaatggctcctctcgtaaacagagagaccggtctgatcgatatcccattctacgccagtgccagcggaacggcacagaagaaagataagcggagacggagaggcgttcaattcaaatgccttctcaatcctgagctaactcccggggttcttgtccgggtagagtcggatagattgtcaggaactttcagaatcaacaacgtccgaatctcgggcggatacagagacaacgaatggtacactgaatgttggtgttccgatcttaaccaagaggatattgaccaatgaggagaacaggcctacaagagcttctgaacctgcactcgtccacggaaggctcgaaacagtatactgccataccttgtgtggtattgcgcgttctggacgattttagacgcctttctgtcgatgttagaccagtggtcaatgacctgtacaaagacggcacatcagaagaacaaccagagattctatctgtccctgtcattatgccgggaacagctaacacccttatcagcttcccattgaatgtcggggatacggtgttgtgtgtattctctcaaagaactatggacgtgtttaaaggctctgccactggacagcctcacactccaaacgatcttcgtaagttcaacatggcggatgccattgccattcccgggctgttcaccttccctaggtcgatgaacgaccctgcaagacatagttggccacatgataccaaagaccttactattgcccacaacctgatgacgggacaagaggcggaagttaggatcaaagccaatggagatattctaatcaacagccgcaagactataagcattaatgctcaaaatgtcaacgtcaagtgtgcttcactcactgtcgatgcagcccatacaacatggaacgggaacattgcacatacaggtaactacgtgcagactggtggaacttctacattcaacggtattccattccatacccacaaacacggtggtgttatgccgggcggtggtgttactgctgtcccacaagcttaaaaggagatcatatggacttgtttgtcaaccccgacacacatgacttggtttttataaatggtgaagctccagtcactcaacgaatggttgatattgttgctcagcgactaaagatcaaactgtacacattcctaggtgagtggttcttggatgataggatcggcatcccctacttcgagaggattcttggtaagtctaggagccttcccgctgttgacgcgatattccaatctgagattatgagagaccccggcgtccttgagattacatcttggcagtcggggatcgaccctcacacacgtgaatactccatggagttcacagtcagaaccacagacaatacagaatcccttcccatcactttcagaatgataggagtttaatatggctggaattacagcagaaggtctaacgattaaagacttggaccaaatcctgacagactacagaaacgtagcctctcaggtcttcgccgacctagtttcaactggagacgaagttgacacgtctggtaactctgctctaggccgtctgatcggcgtagttgctccatcggacgaagctatctgggaagttatccagatggtgtataactccttcaacccggcagccgcaactggcgtggctctggacaacctagtgtccttctcggcaattagccggcatgctgcccgtcctacccgggctcaggttgttctagagggcaacatcgacaccgttattaactcgcctcccgctaagatgatttccagcagtacaggccgagtgttccacctgctacaaggcgtgatcctcactcctaaagcttgctctggtgttggaatcttccctcagacagtaggcaacgacctgacatacgagcttaagatgtacgttgatgacattaacacaacgtctatcaagtacacaagccctaccactggtacagtaacatccgagtccatcctagcaggactggccgcagacgtagctacaaatcacggaaataccttgacaagctacgaacagaatggtatacttttcatagtacctattgacccattcaacaccaagactttcgaagaagcctccaacctgagtattcagaaggttagaaagcttggtatcgctgttgacgacgttattggccctgtgcctcagcaagctctagctatcgatacgatctccattcctattgccggatgggacagcgttatcaaccctgttccagctatcactggccgtctgcgcgagaccgacgatgagcttcgcgagagattccgaaactctaaattcgtacaagccaccaacattctggagtccctaatcgacggtctgatgaacgtagaaggggtagaggatgttaggattattgaaaacgataccgacaacccagaccccgttcatggagtcccgggacactcgttccttccaatcgttcttggtggtattcctacagaggttgcacagtccatctggctgaacaagccattcgggattggttctgtcggagatacagaggttcaggtagtagacagtctaggctacactcacagagtcaactaccagcgacctgtcgaggttccaatcgagatcaagatcagtgtaacaaacacaggatcgatgccagagaacattgaagatatcctacggccaaggattgtagcgtacgggaccgagaattacaagatcggagacgacgtaatttattctcgattctatgctccaatcatggaagtcccgggcttccaagttaacagcctgacgattgccaagaaaggacagactcaaggcatggcgaacatcgagatcgggttcaaagaagtggctacattcgccgcagcagatatcaccgtaactacggtgtaatgatagaaggagaattccatggctgtcaaccaatttgacagagaagattatctggaggtggcccgggaacgggtcactgaacagtttaaagagaagccgatctttgatcgcttcctgcaagtgctattgtctggtaagtttgatatccagaatgcactggaagacctccagactctccggtctctggacacagccaccgggaagcaactggacattatcggagacattgtagggcgaccacgcggtctagtgtaccaagatattttcaactattttggattcgctggaacggagcgtgcaggttctttcggaagcctgtcggaccctacggtcggtgctccatggtactcggtcggtgctccaactggtaacgccagagagccgagcgatgaagagtatcggatgatcctgaaagcaaagatcatcaagaacagaacaaactcaaccccagagcaagttatcgaagcttataaatttgtattcggggttcctgaagtattcctagaggagtacgctcccgctgctgtccgtatcggcatcggtaagattctaacgaacgtagagcgtagtcttctattcgacctaggtggtgcaggtgcattgcttcctaagactatcggggttaactacacatacactgagttccaagctggccgggtatttgctacagaaggcttccccggaggacaaggcgttggagacctaaacgatcccactgttggtggaattctgaccaacctagtgacataaggagttataaatggctgatatcggtcaactacctattgaaaatatttggtccacaggcggggatatggtagccccgacccctgcgcagcagcaaggcggatggggtattcagtcggttcctcgccaatggtggaactggaagtggaaccttcacgatactaacctagcgtatttgctacagaagggcatcccagagtggactagcactcaagagtatattgcaaacaaatcgttctgcacaagaaacggtttcgtctacaaggctgtccgtacccatacaggtagcgacccggccaccgttagttcgaactgggtccgagctttcgcagactttaccacagctagctctgcacttggaagcctgactccgagagaaggagggattcctttcttcattagcgcatctggtgcaggtgtgtttgactctacggcttatggacgtggcatgctgaacgtagccaacgcagcgggagctagagactacatttcggctcaagagagttctgttgtcctgtctaacctgtctactgtgactagggctgccaacgcggttccgtacttcaacaccgacacctcgatggctaccttcaacattacagcgttcggaagaggcctagtcaacgcgggtgatgcaactaacgcaagaaccttcctaggcctagctaactctgctactatcacggctgatccagccaacagagcacacactctggtctatagagacgctgctggtaacttcaacgctggtgtgattacagccactctttctggtaacgcgactacagccagcaagctcagggctccagttacgattaacggcgtagcgttcgacggaagccagaacattgttctgccgggcctagatacaagctacgccggggttgtagcgaggctccatattaatggagctaacatgaccggaacagataagactacccagttggctcttagaaataaatctgatacagattggattagcttggtggctcctgatgacagctcgttggtatttcaatttagagggccagaagcggctaacgccactctgcgggttaactctaatgttgtgttccacgcgggaaaccagtatggactaggagctactcaaacgcaagccagagagcggctcttggttgacagactggcacagaacacgtctcaaactgtcctgtacaacgcagataagagcaggtacttctggttgcaagataacggtgtttccggtatctgggacgcaacgactaacacccctctatggcgtttttctagactaggccagctcgactacggaacagtccctgttgcacaaattacaggattggccaactccgcgacaattccggcatccgcctccaatctgactaatcagattgttgtgaggagcggaacaggagatatcgcagtacaaggcgttacagcgtttggcgctgttctgggaacagactatattagagtaagagccagcactggtaacgctcacctagtattccagaggaatgatggagcagaggtagggcttatttggggaatcccgtctgccaactctctgaacttcaggaccgcaggcggtgcgacaggcatgtctctggctggtcaggacttgactgtagttggcagggtgaatgctgcgacactcaattcgtctggcaacgtcaactctggcaacagcgtgattgctgccgggaacgtgcaggctgctggccgtgtgtactgcggcgatgcttttatgagcagcaacggcaaccttactggcggagctttcggctcttatgggactcttaccaactgggtagactctgtatacgccagaaaaactgacgtaatgactgatgcccaaatcttggctgccacttctagaggtagtgctcaggctgtgggaacatatgtctttgcgattgcagctagcggaagtggggatgttgggactgtagtagctggtacgtctctaaggtcttcgtctcccgtcaactaccacggaactacgctatccggtagctacaggtgcatgggtaggttcggagccggaggttctaaccagattaccttgttccagaaggttgcagattaacaaaataggcccgtaagggcctttataactggaggtgattttaatggaattcagaaacgttgtaaaaattaaagcggggttcgagtgcgaaataaaccatccagaattgggatggattccttacggcgctgtagagggatgccctacgtctcactccatgtacgtgaagatcgccgcagcgattgaagatggctctatggaagtggtagaaaaagaggacaaatatgatgactttgaagccagattgtggagagacaacgagctaacccgggctgaccgtcaagtagagattgctatcgacgatgaagacgaagtaagagagaaggcttggcgtaagtatcgttctgcactacgtaaatggccagagcacaagaacttcccatccgaaaagagcaaacctaaagctcctaaagaataaggcgaggtaatatatgccaaacattatgaagcctacgggtattaacgctatctggtctgaaaacggccagaaggttgacccgggtgctgtaaaagttgggcttggatgggtgacagaactacctccctaccaaactgccaacttcattgaatacaagcaagacttgttcaacgcgcacgttaaccagcacggtattcccgaatgggatagcgtcacagagtatcagggtaacctgagctacactcaaggcgctaacgggatcatctataagtgccttagaacccattccgacaagattccaactgaccctctgaacattacagccggatattggcgagtggcgtttgaggatgcgggagaggcagctaaggttcaagccaaccttgatcggcatgtaacaaactacaacaccctctctgggattggcaacgtagttattgcaagacaaaacctaagtgtgtatagtaaagctgaaggcgatgcccggtacgctatgaagcacgggaacggctctaatgtcttcagcgttgccactgccacacagccaactcacgctattcctttgagccaattggccactctcgtccctccggctacagagaccgttagtggcgtcatgtcgattgcaacgacaatcgagacagaggccggcactaatgacgctaaagctgtcagccctctgaaagccgctcaagtgtatctgaaaaagaaagataacctatccgggctgtctaacgtaactgcggctagagctaacctaggcctatctgacaccgctacaatgccttcggctacgttcctgaaggctgccaataacctgtctgatgttcctaacaaggcattggctaggtctaatcttggaattacaagtagtgctacccagccggaaacctatttcttgaggagcgctcagaacctagcagatgtacctaacaaggcacaagctagagtcaacctaggcctcactgggatggctacaacagaccctgcggcggttatgatgaaggcagacaaccttgctggattggctaacactgctaccgctcggtccaacctagggctaggcacagcttctactagaaatacaggagacttcctgtcgtctgtggctaacctgtccgacctcacgaacgtccaagcagctagaaacaacctagggttgaagggagcggctacgctcgatgtatggggtcttcctgcgaatacaactgctatggacttccagtctaatcagtcggatatttccagaggatgggctcgactaccaaacggccttctgctacaatggggaactggtcccggtctgtctgatgacacaaggacgaatatccaactccctgttccagcacgaatcttgaacgttcaagtgaccgtaatggggacgtttaacaactccatcggcccgggcgctttcatgacggatatgtggagcaacaccgggtttagagttagctgcaactggggcaactggtcttacccgttcaactggtttgctatcacttccaccctgtaattcaggagtatcaaaaatggctctaactgagcaagacttccaatcggctgccgatgatctcggagtcgatgttgccagtgtaaaggccgtcactaaagtagagagtcgtgggagcggctttctactttctggcgtccctaagattctattcgaaaggcactggatgttcaagcttctcaaaaggaagctaggtcgtgaccctgaaataaacgacgtttgcaaccctaaagctggaggatacctcggcggacaagcggagcacgaacgtctagataaagcagtcaaaatggatagagactgcgcacttcaaagtgcctcttggggcctattccagattatgggattccattgggaggcactaggttatgcgagtgttcaggcatttgtcaatgcccagtacgccagcgaaggatcgcaactaaacacttttgtacgcttcatcaagatcaatcctgcaatccacaaagctctgaaatccaagaactgggcggaatttgcccggaggtataacgggcctgattacaagaaaaataattacgatgttaagctagcagaagcctacaaatccttcaagtaaatctaggaaggttcctaatgaagaagctattgaaaagctggaagttctgggctgctgtaggctctgcaacttttatggctctggaggccatggttcatctttgggagcctatccttcctcccggcgtattcgccgcagtggccacactggtagctgtcggtgtaagaatttcggcagtgtttgtaactgctggtaaagtggaggaagcgatttcggaaaccatagaagatggctcaatagaaaatgatactaactaaactcaaaaactacgccctcgtagtagctgccgcaatggcagcagggtttggatatctgtcgttctctttgtacggcgacttagctgttgcgaagaatgatatccaatctcttcaagctgcgtctcgacagatggaagagcagttccagaaagagcgagcagggtgtgagatcaccactgggagactagaggcgcatatagcccaaatgaagaaccgacaggagcttctgcaaggccacctgtgtgagcttgagtctctacccaacccaaccccaagggagacccaagaaaatgccacagagacgatctctgagccttctactggggatagtctggaccctgctcttacaagcttgctcgacagggccttctgttccgcagtaccaaacgatccttattgtgcccccggcaagcctgaccgaggaggttaaggtataccgagtggagcaagatacagtcaaggggctcgctagagcttacattctaaatactaacagtgctgccatgtgcaatagtcaactacagacaataaagctatgggcagaagagcagagggctctatatggaaagtaaagacggcaaagaaggcctaatcaaggtagctacacagggagttatctctctgctaattgctatcctaatggcttggtctggattcctaagttccagtctttctaagcaggaagaacgtatctttgcgatgcaaagagatatggtatccgaggcaaaacttaacgcactagagtcgagattcaatagccgacttgaaagtgaaattagtaacgtaagaagagaacaacaagaaaccaaccggtatttgattttgattatgaatgccgtcaagggtcgggatacagaaactcaataactataacccgttaacccacactgggagacaatataatgacaaggaaacaagactggccgctagtttcagcagtcggggctttgtttatctccctccttgtctgtatggctattctggctttcacagcgatgactcccgaggctcggtttgactctgtacgccagacctacgagattcgaattagcgaatctgagcggcggtatgaactcaaactgaacagactacaggatcagataaactcggcctcgtacacacaggatcggcaatcccgtttgcaatatgaagaactcgactcgcttaaaaggaagattagcgaacttgagcggagaataaaagaaaaacaagaataattaagccccgggagcgaaagcttaccggggctctttgttatgactgggttgcttcccacacttcgttaaacagttcgtcgattttggaggaaatcttggataccttctttttacggagtcgattagcctctggatcggagtgaacgaggctcacgtcgctagcgtttccccagtccatttctccgttttcgaacagaactttaatgttcagattattagctgctttgtcaatccctgcgacaactccgatcaccatggcgttatatttctcgaatgtgggccttggattgtccatattcagggagttcaccttaacaacctgacccttcttaacgtcctctagtttcattttactacctcctcagtctagtttcattagcgtattgaactgatacctcaaagacttgaaagcctgtgggccatcgtcctccgctccttcatggatatgatgagcgatcaagtgtatcagtcctcggtctcctagcaacacagagctaggaatctcttttatccaagccacaaagcaacagaagtgtagaacttccggcatggaagccttgaagctggaatcgtccagcttcgacaggcgctcgtaagtggctttgaggtcgggatagcttaactgatacgtagcgtcgtcgtcaatatgctgatcccctctaactacatactgcaagctcatattacaccttcttgccgccttctgcaagacgtgcctctcgcttatggtccgcacgggtcatattgtactcgatcttctcgatgatcgcacctgcaacatctagacctcgaacattagcatagtccatgatacgaatgatagcgtcagccagttccacctcttccatcttccgctctggcaagtgatcgtccatcaaatccttacggactccttcagccgcttcggcgatttcagtggtaacgagcatcagcatgtgcagagcatcacgtttaatcggctcgcctgtgaccagatcggtgttccacttgcggttaacaacctcaagaccagtcatcattttgttaaaaccgctaacaaactcgaagacggactctcgttcgaatagttcaccgaatgttggctcttgatcttcgacaattgcagtgtggaaaggccactccatccaagcgtcatagcactttttgataagctcttgttcgtcaatgtatgagaagaaatcttcatatccatcaatcgcattaacaacttcagttcccctttcccaattgcgcttatcaataagtctctggtcgattcgcagggaagtgctgccaacttcttcccatgatctccagcctactatgccatcgccgaagtacaacagaatgggcagattgaatccgcgttcttcctgatccttagtctccatagctataacaaacgccggtactttttctccacttacgccattggccaagacgaaagaacccaagtgggtggtctctcggctagctgggcgatgagcttcctcgatatgatctttaactctactcattaacttcaccctcctcgcagaacatttcaaaataacaatcgacacaagttagcatgccgtcgtcgcttacaacctcctcgggagggaagttgttcccgcaacattcgcacacaactcgatcaacctccccgcatccccagtaagccatatttactcctccttcagaagatactcattgctaataactttgaagctgaagtctcggctcatgcttttgaaaaccaagccttcccggtacttcccgttcaacgcagactcgccactagccattttaattacgagttgcatgtcttttggaacgcctacgtcccacatgtacaccggcacatgtttgaccgtctcaccacccaactggttcagcgtattcagaatggcaagacgctccgctggaagacagtaacgactgtccgaaatgttgtagatatcgtacacatagtattccggtttgtcaactccctcgaagttgccttgaatatttggtgcaaccagttcgccttgaagggcaatattcagaccgaaataccggagacgttcaccaagattaagctcttctgccatcgcagtgaagtgattggagtctttcttaatcacacgcttccagccccgacccttgaagaagttcttgatagcagtgaagaacccgatcttctcgtcttctagacggaaaccgacatttcgagacgccacgcctacttctccgtccttgtgccagatagtgagagacgaaccgtccaatttgaatgtcacttcaaacttctcgcccttctgatgagcctgatcgtaagccatctgaatattttgtacgcgagcctgatccgtcttcgggatgaagttggggaaccctagcttggaagtgccagtccggctgcccttgttgcctccgttgatagctacctgctcggaaggctttacatacttcaggatgcccattcgatcggtaacatcttcgtctactttcggctctggactgcccgctgcatgaacaggtacgatcaatccttggctaagctctttgcgaagcttcatggtcttgattcgagaatactcttttccaccttgttcgaccatattacggccacgcaggaattcaaagatagggttgtctacagggaccatggagtccacttcaatgtagattgccagatcgccagccttatactccccgcgtttgattacgcactgccaacctccaacaagcgccagatcgaggctgtcagcgttaggatgggtcttcacatcatcgatacgaactactcgggctagtacgcggtcttgggaattgctcatatttcctcctttattttaaatttactagattaattgtcaaaccaaccgagattaagggcgtgctccaaggctgcgagaagattctcagcatctagaagatcacggatcggcatccaactcccactattccccggtaagccatctgcgatgtacacaggtacgtcagtatactcgctctttttaagcccgcaggcacaggctacattgtctccgaagacaatctcgctgacttcccttgcctcgtctcgaatatcaatcttcattatgtttttctcctgttgtgttgaaagtcgttgtattctgcatggattcatctgctgtgtcaatagccttgacaagaaaataatccgtggtaaagtgtgaggcctgctggagagaaatgtccacgtcactcaccggccagcagtatagcgtatgaagaggaaagctgcaagcgcatcctgagtcgaatctgagaacagggcagcgacgacccgaaaggggaaagctcagagcctataaggagcccatgctccccgctcaccgactcatctgcatatgcgtatatctgcatgagagcgagaggcagaccagaggcatgtcttaggcggagaatccgtatggcaagccttgggacaggtctgcctccactaccgatctatctgcatacaagagcttgacagtatcctgtaaaccgtgtagagtaatctcaaatcaaccgcagaggagtgtataaatgaagcatgttattcaccgtgaagaccttatcgacctactacgtgatcgtatgaagcttgaagctctagaagctggcggggtggacaactgggactggtatgaggcctcgctaatcgactgcggatacttcgatgacgatggccgggagctagaggtcgaagctcttgcagattgcttcccaaccgtaggtgcgtgaccgtggaggagtcgaaagctaccttcaaagacccttaccctaggttcttcgacgcttctcgtaggtatggcgaaaccaacgactgcatggtggtgagctttgcagtcgtatggaacaccacctatgaaaaggcacaccagcacctgaaagtgaagtgcaagcgcggttaccggcaaggggctactcagaagcgcttcagctacgcagacacttggtgccctaagacccggatgctctaccgggaggatgctaaggataagactcttaggcagtttgctgaggaaaaccctgaaggtcggttctggatcgcggtaaagggtcacgctattgcaatcatcgacggagtgttgtacgatcacactaatgacaagagacgtaccatccggcactgctggcaagtgtggcccggagaggcacctgaaaaaatcgagaggaagcctgatccaatctcacctcctgtgagaaaggccccggactggtatgtctaaacacaaacatctgaagtacaaagaggaggatttatggaaattatttcgagagggacactccctcaagaggctttgtttacggctaagtgccaccattgcctaagcattctccgagctaagagatcggaacttgagtatgtttcgttctcattctgtcgccccggggagactgggtattatttcgcagagtgccctgtctgtcacgaagaggtgtctgcttgggttgcggctcctgtcattcctgtggcaccggccaccacggagtatatcacaaaggagcgtaaataatatggaccagttagcaggattcatgggcgaacctttcgtaattgcgttcgactacgacgagacgatcagtctctaccctcttgccttccgaatcgtcatggataccttcaggggctttggaggcgctttcaatgtgatcgtagtcactgcacgccaccctgacaacagcggagagttagagtggctacgggactacgggttcccgatctatttcacggcacagaaggcaaagcgaccattcatggaaaatcttggaataaaagtctctgtatgggttgacgacaacccgttcagcgtggataatgaccttcctccgtggacggttgagcaatatgaagcctacatggaagccaagaaacaacgagctatcaatcaaaggaggagtgtgtatgaaagttgaagctaatggtgcagaacgtagttttatttcccattgggatggctgggatagtatggacacagcgtgttttggattttatatcaagccggaatatgtcctcaatcctgtgtttgcagcaatgaagccgagcttcctagaaatggactacgagaattgccggttcacattctgggggaacgaggaccaaggtattgaggggaagcttgctacaggctcattcagcctcgtcgagggcgactttgaaatctttgtcaaggacgagtaagtggcaaggcagacatacgaatctgcatcagatagggcggtcgaggaggccgtccgttctgagctagagaatcggtggaagtgctcgcttcataagctccctagagcccactacatggactgggcggcatgccggaacggcaaggttgtcagctttgtagagcttaaagctcggaacaatgagatgcagaaatatcccgacttctttgtgtcccagatgaagtggctccatgggatcgaaatgcaaagggtgtttgacattcccgcattccttgtggtaaagtggacggactatacaggatatgtcaaaatgacagccaatggcgtcaactacatgagcatgggtggcaggattgaccgtggagactggcaagaccaagaagttatggtccatatcccgctgaaagacttcacacgtttataggaggacaaatgaaacgactctgctaccggtgtatgcacttcggggagcccaccatgcaccgccataagacgggcatttggtataagggttgtagtaaatgtggatcaggagtattctatggctaagaagaaccctgtgtttaagtttctgaacacagtcaacaaaccctcggtagagagggataaaaccaaatacaggcggaagcctaagcataaacagaaggagcgattaaatgaagaagggtgacaaagtgaagatcaatgatgacgctgataccatcttccggggccgtgttgccactatcatcgcagtagacgaagagggttgcgttattgatgtgggcagctacgaagacgaaagcggagagcttatcgagtaccttcacctgttcttcgagcgttctgagttgtccaagcaggtgtaggagggtataatgaacggacccgagtgcagatggtgcggagagaaaactgaagctgagttcgtagacgttgggcttggatggacgcagcaagtcactggaggcatgtgtcaccagtgtggagggtacgagaacggttactaccagaacgacggaaggctcacagaggtcgagtttgccacctactggagtggtccgttcgaagattatgcggatttctcgccattcaatcatatgagagaaggcgactcgccatgaaggctacactgagaaaccacaatctgctatacatctacttccacacgttctcggaaatgaatgagtggttgacagagaacgctgtagatcaatggacagtcacgactctgggctccggctatcaggtggctgttcctatggaccgtgcaatgcgggaccaatacgtctcggagaggggttgacacgaacacaaggtgatgctaaactccgtggttgtctgaagtaaggaggttttatgtccaaaatgaccgtggcccaaattgcggctatgcacggtatcgatttgtattctgaccacaagaccgcttgtccccaatgccggaagaaaggcgctgacaacagcggagacaacctaaaggtctatggtactgatcgtaataccggggaacacaaaggtgcctattgttgggcgtgtgggtacaccttgctctctgaagagcaggaaagagacgcccggggagaagacgaagaggagtggaatttcgtgggaactgaatttaacgcagagatcaacgctcaaattaaagagcaatgctcgtatgatccgcgtggttatcgtggcttgtctaaagagacttgccagtatttcggagtgctacatggtttcgacccggagactggcgagattgcaactcagctatatcctactactactaattacgaactcactggttacaaacagcggatcatgccgaagaacttctcagagcctatcggcgagaccgggaaggattgcgagctttttggtcagttccggttcaagaatagcaacagcaagaaggtgcttattgtaggcggtgaggttgaccagctatcagcattccagatgctcaaggagtatgacgaccggcgagcaggcggtaagagcgactatgaaccgactccagtggtcagccctactatcggtgagagcggggcatggaagcagctacaggctcagtatgagtggctagacaggttcgagcaaatcattctctgtttcgacagtgatgacgcaggacgagaggcagcagacaaggcagccgataagcttccgaagggcaaggtgttcatgatggaaatgaaccgtaaagaccctaacgagtatttgaaagctgggcgtcaatcggagtttgtcagtgcattctatcgagcccgtacatggacccctagcggtattgtcgggtctgatgcactcgacgctcgaatgtacgaagctgtgcaggttgagaagattcctctgccaccgttcgctaagaagctccagaaggctatggcaggaggcatcccgttgggccggattgtgaatatcggcgctgcatcgggcatgggtaaatctactgtagtggatgagttcactctgttttggatttataactcgcctcatatgccgggtactgtgactctggaatcggactgcggggagtacgcaatcaagctgctgagccgtaaggtaggtgagaaggcagacttgtacgagaccgttgaagagaaagtggcgttccttgatcggcaccgtgatgctcggtacgacttgtggcacaaggaagacggaagcccgcgcttctatctgatcgatgaccgagacggaagcctagcagccctcaaggctcaaatcgagcaactgattattcagttcgagtgccgcgtgattattctcgacccgcttcaggacattctggatggtttgagcaatgaagagcaatcggtgttcatgcgctggcagaagggtatgaccaagagccaccgtgtgacgttcatcaacatcaaccacgttcgtaagagtggtggtggtcagaaggctaactcggcaggtgcggaactgtacgaagaagatttccaagggtcttcgtccatcttcaaatctggtgcagctaacattctgatgtggcggaacaaggacgcggagaacgagttcgaaaagaacctgattaacgtgaagctctctaagtgccgatggactggccgcactggaatgatgggcaattggtactacgacgttgagactcatacaatctgggacttggacgactatctggaccgataccctgacaagcgccgtgaatacgaggcttggatggctcagaaggaagaggaaggccgggacacggaatactaaggttgacagaggggtgatgcttatgtatcatccctttcgtcgtttacaggaggaaaggaaatgcaacaacgatttgaaacaatcgagcaatacctcgaatggatgggaaataacaatttcaccaacatgacttgggatatcgaggccacaggcctgttggatgaaacgtctatcgattacactgccagcccctacaagattaagcctagctacaaacaccactgcattgtagtggaggagcacggtggcaatattctggcattctacgatgggccgacctacgtctttgacgggcgagagtacactgagagactgccgaaagcgtcttccatgctccacactgaagaagttgtgactctcaaggactacactccggtagagtatattcacctgccgctgaaagagttcaagaactatgtgctcaagcgcaagatcaagcgcgtagtggctcacaacatgattaacttcgaccttatgtcgatgaagcttgtggaagatatggactttactatcggcgtcgagcacagggatggtggtctaactacttggtcggcagatacttggatgggcaagcaggtggtattcgacgataccctcgttatatccaagacttgtaaccctgacctgttcggcggtcacagtctggacaagctgtctcgtcgcgctggtggtgacaccaagattgacttccgcaagcatctggcaccggatgttcgattcctcgacttcgctgccgatatgctttactactgtatctatgacgtaaaggcgaacaccgctgtatggcactggttgcaggaccacgaagattaccaactgtccgaccgagacaactacatcaagaactggttgtcgccgattcagttggagaagaaggttgcagagataatcacctatcaggagcaccgagggtttgttctgaatgttgatctctgtgaaaaagctgtgaaagacttggacgccaagatggaagagcgtcgggcccgggtagagcctgtgcttcctcctcgaccagctaccaagaaattcatggcagactacactccacctgttcgacagttcaagaagaacggggagatcaccacttacctacagaagttcattgaaaagatcggcgctcaattgaaagagggcgatgatcggactatgatctttgagggtaaggagtacaagctgcctctcccggcagacgtacctctgaaaacggagatgcctgctaagattggagatacaacccacatcaagcagtggcttatgggcgagttcggttggattccctctgagtggaaagagacggacctcactgtcgaccagaagaagatcaagctgccgatggaaaacatcgttgctaagatcgaccgctggctagatgtgacgtacagcacagcgtacaaggaagagcgtctagacgggttcggggattacatgaaaatcactcctcgtagcacccgggcgtatgtacgtcaaaggttgattgatcgtgcaagcaaggggggctgtaaggttctcactaaccctagcttcacaaagggccaagagaaagaaatgtgtccagacctcgaacgcattgctgaacagtttccgttcgccaaggatgtgattgagtacctgacgttcaagcaccggagaagcgcaatcctcggtggcggcatggactgggacgaaatggaggatggagaggagccggaaaaaggttaccttgcaagcattcgtcaggacggcaggattcctacgcctgctgacacttgcggggctgctactagccggatgaagcaccggaaggttgctaacgttcctcggatcacctcgttgtacggggctgagcttcgagagttgtttggggttggagatgggttcttccaaattggatacgacttcgattccttggaagcacgtaaagagtcggcctactgcgatcagtacgatccgacaaaggaatattgcaaatctcttatgatggagaagccattcgacgttcacactatgatggctaagcgtatttccgagattatcggtcgtcaatttaaccgatctcctgcgaaaaacgtaaaatatggattgactaagtaacaacggtccatgtaaaactgtgtgaattcaggggacagccggaacggccaatcctgagccaagctagagtgatctagaaaggtgcaacgactatcgaaaccacggcgggagccggaagggagtagagtagggtcaagtgacccgaagcgcacagggcgcgagagcgtcatgatatagtctggtctgcatgggaacatgcagcggtaacccttgagcaaggttacgggggaggattaacgaccctccctgaacacaacggtacatacggcgctcaagctggtaaagtggcgaaaaccattggtgccgatttgcaaacgggtcaactggtgtttgatgctttctgggatgcagcattcccattgaaagcactgaaggatgacctaaccaagcagtgggaagccaacggtaagaagtatattgttggagtggacggtcgccgagttcctactcgttcggctcacgctatcctgaacagcttgttccagagtggcggtgttatctgtgctaaacgtgctatggtgattcatgaccaactgctggagaaagaaggtctgaaggttgactttttcaaagaagactggaagaacaagccggaattctgccaacaaatgatcgcgtaccacgacgaagcgcagttggaagttacagctaagtcggttagcttcaagatgttcccttggtcccttgtaggcggtaagccggaaggtgagaaggagctagaggcagccgagaaggagttgaaagctctagctcaggcttacaaggacgaacaattggctagcactggcaaggtgtggagtgatatcgcacactacagcaaaggtgaaggcggggtgtttgtagcttactgccgcgctggagaacttgccacgaaggccgtgagagctgcgggagagttctactctacccctctggtgcctatcgagctgaccgctggctacatcgttggtcgatcttggaaggattgccactaaaactggcattaagcgaggaaaggggcttgacaggcccctccgcctcctatacaatggccacatattcacgacacacagaggagaaaaactcaatgactctagcttttgttatctatctcgttatgaccgtattcccagccttgtattcggcagggagttttaccttgatagttactatcatcgcgtgggttgcaggagggtttgtttacttggcatcgattggtggccgagaaaatgaggcagttaaagctacactcaaaaatcacctccggcccttgacattcaagctgtttctacctatcattgtaatcggccatctagtcccctcgtctgaaacggcatggtggatggttggcgggtacgctgcacagagcctctatcaagcagacgctactcagcaggttctcagcgaatctactgaactactcgaagctctggttaagcgggctaagaaagaaactctgaaggctgttgaaggcagcagcgagtaatctacagaataggaggtatggtatgaacacggctcgactctacgtctacggcaaatcgtccatggtagggatcactgttgacaacaaggccaatcgagagtactatacctctaaaggcttcgaggtatcggagacaccgttagcccacaaaagcgtggctaacaaatacaaacagaaaggaggtaaataatatgtctggtattatccccgggactatcgtcaaactcactcaagtgggatgtgacgtcacccatggctggccaaatgaagcccgctatgtaggcgcatacgcagtagcagtagatggacgtgatatcggacttgcgggagatcaaatccggttctgctccctccactggtccattgagcgagatgttaatgatggactcggagactaccaaatgctggtagaggatgcaggccgctacgaaattgtagcagttccgggcaagaagtattacgttaagaacgttgccaaggacagcgcacagatcggccattacttggttccttcggagccagccttgtacgtaggtttcgagccgtgctggctgaagagcatgcacgaaggggagagcccgttctgcatgacttttaaaggacgcgttgacattggcggtgaaacctctgacaagccgcagttccagaccctctaccctgagctggtactggaagagtttaaagaagaggtggagggcaaggttgaagctccggttgacgaagagaagaaagaaaaggttgcaaagcctgctgtaatgggttatgctgttctcgatgtagacggaatccctcttaaattctgtctcactcgcgaagaagcccgagccaccaagcgctggtggggtggcaaggcggaaggcgtatcgattgtgaaactgattaaaggagaggaggtgcgctaattgcgctaatcctcttgcagaatccgggaatgtccggtatgatcgtcggtcaagtggctgacacactcgcccagtctagggtacttaaataggagaaataaaatggcttttaaactgaacgtaactaccaacactcaatccggcaacggcggcatccgcaaggaagtcgattgggatgctctgaacaaccacgtcgtggaagctgctggcactgccgctaaagcacgttcgatcccgggttatatctccggcatcatcgacctcggcgagcaagagcagaacgatgcagaggttgtgttcactggcactgccgaagatgaaatccaaatcatcaaggaatacccgaacacttacttcaaggacggactggacaagcagactcgtaaaccggtacgtctgaagtgctggccgcagcgcgatatgcaacaaatcgcgatcactgtggacttccctcagatcgaggtggacaagagcctgtacctgaccggtaacagcaacaaatctccgcttcgtgtcctgtacaacggcgactttactctgccgggtcagaagactaagattgttggccgtccgttcaccatcaaggaagtgaagcacccgaacggcaaatgggcgttcgctaagaactccatgctgcacaaactggctgtagctactggcgtcatcaacgaagacgaactcttcaccaaggaccgcgtaggcgagcttctgggtaaagtggctcagttccaagttcgagtgtggatgaagccgggcaaaaacgacatgaaattcctcaccgaggatatcagtctggtcggtatggtgcctgaaggtgttccggtccctgaactggatgagaagtacatctacggcgtgaacctgtatggtgagaacgacgaagaggcagttaagcaactgcgtgccaacgtcatcaacaccatcaagcgagccaagaactacgaaggttctgatatcaaggcgatgatcgaagctgttgaagctgcacgcggtggcaaccgctccagtggcgacagcgaagagcaagctgaagataagccgcagacccaagctgcacctaaagtggagccggttcaaaccaacgtagatgatgacattccgttctaaagggcggtggtaagacaaggggcttcggccccttcctttcaaaatttcaaaggaggcaacacatgcaaatcaattttggtcccatcttccttctcgcagcaatcgtcctgtgcgttctgaaatctgccggagttctcgctatctcttggactgtggcactaatgcccatctggattcccttggtgattgttctatctgttctcctgctgctgcttgtagttgcaggcctgatttacgcattcggggatcgtagtcaactaaacttcgcctttaaaaagaactacagccttaaaaagaactttcgaaataagtgaggactaatgatgagcaacttggttattgttcgagtacctgagtacattctgaaaggccccgcagtacaaaatcagtttagcggtgaggtgtgggaacgagagcttttcaaggatttgaaagaagctgcgaaaagtatcattgaaggagagccagcttatgttgctcttcctaacaaggtaaaccctgacactctacaaacagagtgggacattcaggttgtacagttctaacccaaggggagcttcggctccctttttcattggagataaaaatgagtgaaaaggaagaggatatcgtcctcatcgacggcgaccttatcgcctttaagtgtgcaagtgtcaacgagacccgctccatcattgtcagaaacaagctaacaggagaagaggaaacttggaagaaccgcacgacatggcgagagaacaacaaagacgaagagggattcaacgaggaaaacttcgaaattgaggaccatcaagaccccaagcacgtatcctatggtatctctgttgttaagaccatgatcgaccgaatctgccgccaagctgggtgcaagcagttcaagattctcctatcaggccctgataacttccgtgacgctatcccactcccgaaagaatacgagattaccaagggtaaaaagaccttcactcgtggcggcaggtacaagggtaagcgtacagggcagattaagcctcttcagctaggtcagctaaggcagtatatgatcgaagcgtatgacaccatcatccatcccggagaagcggacgacttgatggccgaaatgatgtacaagaacggtgtaagctactccagaggggagactactcagcgcgtgatcggggctaccatcgataaagacgcagacggcactctaggatggctttgtaactacgaacgtgagcctgttcaagtcaagttcatttcaggcctaggatcgctctacagggactctaagggcaaggtgagaggcgagggacgtaagttcttctacttccagttgctattcggagaccctgttgactgttaccgtccggctgacctgtgtatcgggaaggacttcggggaagtggcagcgtttaacatcattaatccctgcacaacggacaaggagtgctggcaagcaatctacgacacctacaaatcgtggtatcctgagcctgtcacctacacagcgtgggacgacacagagcacactaaagatgcagtagagatcatgcaaatgtactgtgactgtgcccacatgcaacgctgggcgggagatagagtagactgtaaggctgttctggctaaacttggggtagacatgggaggtgcagaatgagcgtaaggccgcgtccttgggaggacttcccgggcatttggaagaccgaagccgcgttcttgagttgggtcagaggtggcattcgccgctacctctggtctaagaacccagtcaagcttgagtttgctaaatcccgaaggatcaagatagccaacaccaatgaaaagagcaagctcaggaatcccactgtatggggttacgtatgcgagcagtgtggaaaggaaactcctcaagctaacgtcgagatcgaccacaagacaggagaattctccctgaagcgagtagaggatatccaatcgttcgtggaaggtgttgtatttgtccgaatggaggacttagctgtcctgtgtaagccgtgccatgagatcaagacctatgcagagcgttacgggctgaccctagaggaagcagatatcgtaaagcaggctattgcaatccagaagcaaaagggatatgataaggtcttcttgcaggaggtgggaatcaaacccgcatccaacgcagagcttagaaaagagcagatcattggataccttaggtctaagaaggagggtggatgaacgaggatcgggtttacattgtagtaagagacgaggcaccagaatacatggtgcctactctggttgcacatagcatcctaggggcagacatggcaatggttctcctcggacaggaccgggccgttccatcgacggaccttccgtcccgtccgtatatgcatgcagcggcaaaaaccgccattaagtgggtggagtggaaacagtggagcttccgtaagatcgttgtacgagtttctgacaaagagtacaataagatcaagcaaatccccttcgtatatgaggggtatgagagaaccatctgcaacggaaagggctcttgtctagtagtgcctcctcttagcaaggaggagactccgaatgttcttaaatttgcaaaactgtggaggccgatgtgagggagaagtttcttaaaatcatgcgaaagctgccaatcagagtacgagcctctatcgttctgatttggatatccatattcttctggctaccggttgtaacagcactcatcgccggaattatagacctcttctgtaccgcaaaggatcagttggaagagggatattcggtactcatttccgcaactatgggagcgctagagtgtcttcgtacaggggaggagctatgacaagtcttgctacttatgttatccgccacaagaaaactaaggagctttggactactcctaaagggaagcgtcaatggacaacaaaaggggctgcggctctagcttggagaaacgcctacgagggtactgcacacggagcgtacgttgctagaaaggatatggagcgctggccggacctaagcatccctatgattgtagagaatggcctccatcgtttggccaaccaagaggccgcagctttcaagaatcaatctgctttcgagattatcgatatagctgagtctctgaagaacgagagtcaattggtactcgacttgctgaaagatgttgttggatttgaagtaccggactctgttggagacggatacgtgcgtctaactattaaaacatccacatatgacgatatcatcaaactactgaaggagacgaaatgagcatgatggaccctaaagcatacttcatcaaacaagacctagaggaagccacaaagctcctcgaaagggcctacaatctactcgacaacgttcattgctatgacacggctgtgtacgaggacattgcagcgttcctctacggtcaagagtgcgaggaggcagagtaaggtgggaatcgatcttaaagaagctacggatcaaataaaagacttgcttgtagctgtcgctctgctagatgaagtccttgtgtggatggagagcgaagacctgtgcgatgcagatgtatacaaacgcatagacgcatttttgtactaccagccgggagaaggcgaatgggaggaggtagaatgagcagtaagaaacactttgtaatttctgacacacaatgcaagccgggtatcaatctggactacatggaagctattggtaaatacatcgtagccaaacgcccggatgttgttatccacattggtgaccacttcgacctagccagcctgtcgtcctacgataagggtaagcgctcctctgagggccgtagatacgccgaagacgttcaagtcggacgtgagggtctggacaggctgttcaagcctctgtgggagctacaggagcgtcaacgggctaatcggaagaaagtgtaccaacctcggttgatctttacactgggcaaccacgaagagcgagcagaccgggctgctaatgacaaccctgagttgtatggcaccgtaggcagcgatgagcttggtattcaggactacggttttgaggttgtcccgttcctcaagcctatcgaagtggatggcatctactacgtccactacctacaaaaccacttcactggtaagcctctgggtggtacagcgaacaacatgctcaaggcggctggtcattcgtttgtcatgggccaccgtcagcttctggactgggctatccatcctacaatcgacggaaaacaaagacttggcattgtgactggagcgtgctatcctcacgatgaagcctacaaaggctatcagggcaacaaccacttccgtggctgtgttatgattcacgaagtgaaggatggttttggtctacctatgccagtaagtctggacttcatgatggagaaaggaggcttcaaatgacagtttataagttctggtgtgaatgggatatcggtatcaatgagtgcctgtggcgagactactaccagatggaagaggatgtagctaaagccttgtcagactgcgggattgaggatactattgaggaactagagggtgcaggcctgcttggcttcgactctgttaaagtgattggttaataggagggcatatggctgagtttttccttggggcggcccttgcaggcttgttctttatgtttagtatcactgcgagctttaccgccgaagatattgagaaagtgacttcaacatgcgagaataacgaaggcgtcaagtatttcggagttgacttcttcggagacggtgctgtacactgcaacagcggcgctattttcaaaatcgaccgcaaatctaaataatcgaaaaggagatataaaatgactgatttcaacatcacccctgagcaaatggaagaagcaatggcaggtatgaacccggagcagcgggctctggtagagaaagccttgaccgaccgtaaatctctggaagattccatcgtgaccgaggacggtgaactggactatggcatgcttgcacgacacatccgcaccagcttgggtgatctgcctctggtaatgggtggccctgacttcctgaagctgatgatcttggttgctgcgatgccggagaccaaagacgatctcctgactctgcacatgaacctgtccttcattctggactgcattcgtgaatcgattagcgacgaggagtaacaagtggaagagattgtaaaagacgaggctgccctctctggagacgatctcatggttgactcggcagggcttgatgccctgctggcgttcctagagagtcagtttaaaggtccgaagggtgtactgaagggatatgtcactatgagagtgatgtgcgctaagatcgagagtcttgacgggtttcaagagttgaaagatatggaggtgaactttgagtaacgatatcatcgacgttcatgctgggcaaccgatttctctggtgcaacggtcaaagaatcctatcaatattcaatattgggacgccgataccatcccttacggcacagtcttggttgttaccgaggaaaggggtgatatacgaaagggagaattagtcgtaaggctggctagtagtgcagatgatgagcactctgttagggtatgtagattctctgatttcttcctcctaatggagaggggttatgacgcagccagtctcggcgacgttaaacaagcgtatgatgctctgttcgaagatcacccagtgactacctttgtcaactgggatcgggctcagcctttgacaaacagtgagcgctactacggagactttctgattggcggcgaccctaaagggatgccactattcaacatggctgttcttaaaaatgttctgtcgccttacactgccgacgatgaggaactttcagctatgtctgggaatcccgagacagtagagcacaaagaagttgacgaactaagtgagagggacgaggctttagccgaggtcgacagactcaatgaagagcttgttgcactgggtaagaaggttgtgttcgccaacctagaagattacctaggcaaagaaaactatgccacattggaagctatggctaaccacaaggaggctgtaggtagcggaggctcctctagttactacactgtcaaggtgaacaaccccactacgaaggctaacatgccgtattttgcagagtgcaacgatatcatcgaagcgctggatatgcgattcggtcaaggcaacatgttcaaagcgttgtggcgggctgcggcagcacagaacctaggcaagctgaaggccggtaacgatgttatccgggactacgagaaagtcatcttcttcgctcagttggagatcgataagattctcagagaaaggggttgacattctccccgaggcttgcgataataggctccaagttgaaacgaaggaggtgtgtagatatgatccagaaagtaaaacagaagctcatggtggtgcatcctgtcctcgctagcgagatcgtctggtgcctcaccttcgcaatgcttcagtaaaacaagggagcttcggctccctttattgtatcaaagatttaataaggagagtttatgcaaatttctgcaaaagtgattcaacacagttcccggatcggcctaggtacgaagaatcacagattcatcactacattcgaactggagtatcctcggtttattcacagtgaacttatgactcaccgactttttagtcgaaatgctgcaagtagtcgtgccattcccgttgcccatatgatccgacaggtggaagagaatcctgcgatgcctgttcactggggaatgaatcaaccgggtatgcaagctgagttcgaactgagtgagtgtttgcagcgtagctctcagtacctgtggaagaaggctgcaaagagtgcggctcggatcgctagcgcactaaataaaatgggactccacaagcaggtggttaaccgtctccttgagccattccagatgatgaagaccgttgttacagccacggaactagataacttcttctacctgcgttgccataaagacgcacaaccggagatcaaggttctcgctgagaaaatgtatgaggctcttattaaagcgggcccggcagaggctctatatgacggagagtggcatgttccttatgtgactcggttccgcataggggatggtaagctgcgttacgcagattgtaacgggcaagaactgagcgtagaggatgctattaaggtatctgctagctgctgtgctcaggttagctataggaagaacgacgagactctggagaaagctcttgtaatctacaaccgattggtagatactaagcccgttcacgctagcccgttcgaacaccaagcaacaccgatgctccgcatctcggacaatcaaactggatgggaagacggtgtgacgcacttggaccaatatggtgacctctggtctggtaacttccgaggtttcatccaacatcgtcaactaattaaagggcacgtatgtaatgagtactacggccaagaagaggaaggagtttaaaaaatggcagaatataacctgagtctggaagacctcatgctggtagatggtttcaaagaggcattccagagtaacaatgagaaggtagtgcgagagcatctatggactaacggcatggatgttaaaaactactcgtatgaaatggttttctgtcaacatcgcacactgattggccgggtcgtagagggtctacgattctctggctttgagcggacagataaagagtggcttagcctcggttgcgcctctctggaagctcatattgcagcgtgtgatgatagtaatctacggttcactcttcgtaagatgcgaccagagggatcgacagaggcaacgttccacaattaatgcagtaggagtagatatggaagttacaaaggctctcgtagatgaggccgatattttcaataagatcacacaaatcaggactccaacggagtcctatgcccggaaatacccggtcattgttgaactagcaaaccagcaactagaagagaagttgtggttctctagcgaaatgaaggtagagctggataagttgaacctgaagttcaagttggaacctcatcagcttcacgctgtaaagactgtcctgcaactgttcctcaaatacgaactgatcgtaggggaggagttttggatgggtaaagttgtccgcacgttccctcgcccagaggttaaactagcggcttcgatcctgtgcatgatggaattggcagtccacgctgaattctacaaccagatcaacgtagtgttggggatggatacagatgcggactatgtagcttacaaggacgaccccgagcttatgggtcgaatggattggcttgagtctgtcctaggcgatgaagacgatgttctttctgtaattatcttcagcctaacagagaccgcccttctgttcagttccttcgctatcctgaagagcttccagtgcaacgggtataacgatatccctgtaatcgcacgcggagctaaccagagcgctgtggatgaggacttgcacggtgtagtttcggctgagatcatcaaccaatactacgcagagattggtcgaccactgtccgaagatactcggcgtgtcgagaagattcgacaggctattgaccatgtatatgctcacgaatgtcgtatcgtagacatggctatcccgggcggagagcttaatggagagtctgcggagaactacaaagcgtttgttcgttaccgtctgaacgtctggtgccgtcgtcttggtctggaagatcacttcgagaacgatgacactccgatcaaagattggttcgaaatgaacacgtacgcttacaaaatgattgacttcttcaccccggggatgggcatggaatacgaactggggtgggatgaagaggaactagcaaaggcttgggaagaggagctgaaatatgagtaagagagatacattcaactattccgaagctaggaaaaacagccaagcggcaggggagactcctctgtggtatacgacggctggctaccagttgttcatgaagaaatattcaaatgagggagagtctgttcgctctcgcttccaagctgtagctcgcgctatggctcagcacgcccctacggtgtatcctgagtggtgggaggaggacgaatacactagaggcaaggactgggaacaggtattcttcgacgttatgtgggacggttttgtaagcccatctacgccgcttctgtcgaatggaggcctccgtaaaaagggcactacggtgtcttgtgctggcggtctgatggacaacaacctctatgaccgttacaatgtaatgacagagatcgcagtgctaacgaagcacagccatggcacaagctttagcctgaccaactggccatcagaaggagacgctatccgaggcggtgagtctcaaggtgtgatgcctgtcattcgggacgttatcaacgtcatggaagaggtagcacagggttctaggcgtggtagctgtgcatacagcatcaacccccgccatggagacttctggaacgttatcgatcacctgtataagcgcacagagtcgaacaacgtcggatggcttctagacgaccagtggtgcaaggatatggccgagaaagacccggagaccttgaagcgatggaagcgaatgatgttcgtcaagctggccagaggaaaaggctacttcacgtttatcgataagatgaatcggcaccttgcagagccgtttaaacgggcgggtctacgctgtgaagcgtccaacctttgtcaagagactgttctcccggcaaatgactggtatacttttagctgcgttatcctgaactacaacctcgaactttaccgttcttggcctaagcaccttgtgtttattggtcaggttatgtctgattgcaacatcagcgaatacctagcaaccatggatgaggtcagcgttcaggaccgccgagcactggagaagatttaccgattcaccaaggacttcagggcgcttggcagcggtgttctagggttccacaccctgctacagcgggagcgattcccggtcggtagtatggatgctatgttcctgaacaacgccatcttcaagggtatgaaggagcaagcggaagcttgtaacagttggctggctgcggttctaggagagccggaggggtgccgtggactagggaagcgtaatgccactacgatgatgatgccgccaactaaatcgacggcagaactcatggccggggcttctgagggtattgggcttgacgttgctatgtgcttcaccaagcagagtgctggaggtgaattcttccgtgtcaacaaggtgcttctggagatcatccaagagcgcgggctggactgggaagagtgcgctagacagatcaacgaacgtaaggggagtgttcagcacgtagactggttgactgaccacgaaaaggctgtgttccgtactgctttcgaagtgagaatggaggactacctgcgactatgctctcagcggcagaagtacatcgaccaagggcagagtatcaacttgtacttcacgtcgaacgactcgccggcttacatttcgtacatccatcgtctggccatggaagacccgaacatcctgtcgctatactacatctatagtatgcggggagctggggatatctctagaacagaagaatgtgaaatgtgcatgtaaaaccatcggcccggggcttgacagctcccgggcctttgtgtattctgagcccatcaaacagacggagggtcaaaatgaacaagtttactgaggtctacttctcttggagtgcagcaagctctcgcgcaagctatcttatagataagggatggactgctacgctccggcgatcctttgtaggatcggagcttacgtgggtagtggagttcacacgatgaacaacgaactgagagaagagtttaaccggtggtgggcccgagaggagcaggaagagcttcgcaaatcttgtgctaaaggctgggcagagtatatctggaggtctagtcgtgaggccctgaaggtggagttgccgaatcctgaatactttggcgattactggtctggggattgggcctacaacgtagaggacaccagagacgcgctcctacaatctgggatcgaggtgatctaatggaaaaatattctaaaaagcgactgatgcaaactagtgagccttacggctcggcaacttacgcgctggatgtagcagccggtctacaaagaactagattttgtgaatttgcctgtgtaacggaggataatcgagtaattagcgtgtgggagtatagtgacgtcgagccagacaaacctgtgcatcccggtcagcaaagggtgctcgtacctaactactaaaaaggggaaagtataatggaacagactattgacaaaatccggtatatcgttctcgacaacgaacagcggcatgttctgaccctatgtcagttagccgttcataatctcctccgtgggattcagtggacgagagataagcatggtcagattcacatccatgatgttacaggcgtggaactcggtgtgcgtcaagggattatcgctgaagtgttcctgtacccggggtatactatcctagaggaaactgaggaatgaacggggcccagaaatttcacagcccggacggtcctgccttcaatcaaggagagctgtgggagagctgcgaagggcatgtggtcgaaattaaaggaactgagcgatatggttctgaaaagtgggatgttaacgtttactacgtctacgtaggtaagtcgcctaatatacccgctgttctagcgagccgacaggagcttccagaccgcgagttttcaaaagacgcttggaacttccaagttaggtatcagcaccaagctgacaaggagatttgatatggatatgttcgacaagtacatgcaagttatgtatgaccgggacgctttctcaaggcgagtcggggagttagaaaaagaggtagccgaactcaaggctaagatggctatcgccaagtgcgatatgcgtgtcgtgaaaaccctactggaggatatccaatgggtgtatcaggacgaagctatctatactctgccgggctacgtttgcccttgctgcggggaatctgcaaactatgggcatttccaaggcagcttcgataagggcccctgcctactggcttgtgtactgagccggagtgaagcatatgaagcctaatgttgtagactcactgggaccgatcatgcaccactcttgtcgagtctgtggcggcaagctatacatccgaggagtatgcactatctactgccctgactgcgagaaggcaacgaaagataaaccgttcgtcaggatgcagcttctacaggatatcgaagacagcaagagggttgacaacgaatagaagtgctagtaagatggccacatcagacagaggaggagccatggctacaacagagaagatcatcgagtatgtctcggcctgtatcgaacgcttgcaagaggacgtaactgggtactcggagaacttccgtgacagggcgttatctaatcgcacagggtatattcacgggcttatcactatggctgaaatgaatgagcaggcgagtatcgaggactgcgacaagctccgtgtaaagcttcgtgaagctgctgaggctgtgttgaacgtactggattccaaaattaactaggaggtgttctgatgaatatgaaagagattgtgcaggctttgattgtcgttgtcgctctgactctcgcagcaataggttttgtagtcgggattactgcgttggccaacaagagcgcgcccgccgaggatattgtcgtgtctactgaagacggcaccatcaatctcggtcgctccgtgaagagcgagaagctgctgtatagcatgtgcatcaaggtagaagaccgcaaacctgcttgtgaattcaccaccaaggaccgtgttcttagcgaagtgaaacaggttatgcgcccgggcgaggctacggcccgcgatattaagattgcagtaaacgcggctgtgacgtatactggtgagaacgggcaggaagcaacctctctgattaccccgaaaggtaagtatctcccggctggcaccccgtctgaagtacatattcaggctattgcgaatctgttcgacagcgtgtacaatgactacaaacaaaacttcagcaagatgtgaggaggactcatgaaagcacagcctaaagaagtagaaaccctgtccctcgacaagcgccccaaggcaggtgatgttgttcgactgcgatctgacggtaaaacctacgaggtaaatgctgtatatcccacggcagtgggctgggaagcgattctccgcaacatgtacgacaagactaagaccgtcactgtcagcatggagtggtgaaatggcaagaaccgtcaagtgcgtaaacttcctacctgtcactccggacggtcgagtaatcgtccgattcggcaagaagaggctaggctggcttgggaaacagggtaagaagtggcattactacccttacggatgcgaaggcaagattaaatcagaggggtttaagacactcgccgagatcaaggcttggattcgagacccggaggctgtatggcccggtccgcagcctgagattgactaattagccgacgaatggtacaatggtatgtaggaaattccctactcaatataaggaaactagcaatgactagccgctggaaagaggccgtgtatcgtaagtactcggtgcgtcgtctgcggcaggaactcgaagagttcaaagaagctagacgctttgcaccaaaccaacgcatccgtgcatggtttgatgctcatatcgaatttctagaacgccacttggctattcgagagtccggccaagcctacccagacgacctttggtaattaggtaattaggtgtgttgtaggtagagattcaaatcatggttagtggcaaggacgccacacttcagcccgcccacaaggcgggcttctttttgcctgaaatttgcggttgacaaggttggccggaatatgtaaacttacggcatccaacagaggagggaagaaaaatgcaattcaatatatcgaagcaactatgggtagctaaaagcgagcggaagggcgactataaagggacgcttttggcatacatgtctcaagtggacttcaataaagatggtagcttggctgccagcttcaagaaaaagcagcagactggtatgagctgggcaggtaagaatgccgagacttgcttcatagacaacatccctatctcggggcatttcatcggggacagtgttgaacgctgggtcactgagaacaaatatttccgtgtgacggaccctaggggctttgttctagaggttcctaccgggaatatctcgaccttgctctacaactgcacagtaatcaagggagttattcaagagccttgcgtgtgggtgcggatgggttctcagcacgttctactgccggaaggctcctctctctacaaagaagctgtaagtttcgtagagcgaaaagagtcggccaaaactgttaaagatatggttgcaggggatcgatgcactcttcttagctacgggacagaggagaaactagaggctatctacctcggacaggtgaagatcacttggcacctcctagctaaaaagggccggtactctagccgagggtggggtgggggtcggtggggttaccaccatctagagagggaactagatagaaaagaattcactgagaaagattcgaagtgggttagtgtgttcgctaagccggtaggaaagcggtggagtatccattttatcctgtctccaaaggcaaccgacattcaatctggaaatgtaccggatgaacttcaaaacctcgacctagtgaatggtgtaaaatgggagtacaacgagaaagacgaccgcccatcttcctattactctgtaccggatagggtagtcaagtgtatcagtgtggatgatcccctgtgggataagctgcacagctcttcggaggtgcggtggacccgcgaatggaccgtggtcggagcagagtggcgaaaataagccaccattattttagaattgcccggcgagagccgggctttttcgtggcaggggttattttcaaattatttttagatttctgggagtttcggccaatatgggcaatatgaaatttctcaggaaaaggctcagaatgctcgtataatagccgttcgagtgtgggcagggtgagctactacttagccgtagaaggacagtgtgacgcttaataggagggttagaatgaagattgacaacggtggcgaatatgcgtattggctagcggatatcaaagagtttgtttctcagatggatgccacagagatcgagaagagggcttgtatagcatacttaattagctggtatcagcgaagagtactgcacagaattaaacgggagggatacgaggcgatctaagctagggaccggatggatttttagggactggatagattttcacaggctgcaaaattaggaactgggcagatttttaggaactggacagtttttcacagaaggggatttttctacagaggaatttcccctgaaatttagccggatttctcagaagggcggatcgttagcaggctatctaattggttagcaagctacctttaatcgttagcacactaactaaaaattcctaggacggacctcagttggcacgaacgttgcaagcccgcaccagtttcccgggcaggcgtaggcctcgactatccgtcgtgaaggcgatatgtagttggggactcgcaccccgcgtttaagatgcgcccattctattatgacaaacccctttgtcaacataattttttatggcacagtctttgcaattgcaattagcgtgccagcctaaatctcaggctccctcggtgtttatctccggtgctcggcctcctgcctgcgttgcccgcctgcctgtcattatacacaagcaagaaaagaaggcaagcgaaaatatagagaaaaatctacataaaaccggttgacacgttccttttatataggcacaatgagcacacattcaacggaacggcaggtaaacagccatgctacatagtgaagcccgggcgatggccctacaagagatggacaagtggagcctcctcgaacaaggttggaaattcagtttcaatctcaggatgaaacggacgctaggccgttgtaatcacgctaaaaagctcatagagctaggttacagctacgtagctgccaatggagtgcctgcggtattagatactatccgccatgaaatagctcacgctaaggcgggaccggatcagggccatggattcgtatggaaagagtggtgcggattgattggcgctaaacctaagcagtacgccagcacaaaagaaaaagtagttaatttcccgtggcaactggcgattcagcacgactccgggcgcttagagcggcttaaccactacggtttcagacggaccaacatggcgaaaaagcaggtacgcgggcggcctgagacaaagggcagactagtttgggtgaagagtgaaaataagggttgacagcttgggccattcgcgtagaatggccctcaagcaaagggaaacaccctgagcagtcacaaaggatacatagttatgaaagcgctttgtaatcatcgggcactctacgcggcttacaatcgtagcgagattgatcgcgtagcggtagacttgaaccgctatttccctatcgagaaagatgatgaatgggaagacggatcatatatgtatcgtcgccgcacctatctggtgaagcattcgaagggtacagcccgttggcacagtctttactgcaatgggatcgtccaaggcgttggcgtcatcttcgacgtgaaatcgggtgaacctttccgcacagcataaaggagattcagaaatgcaagcttggaacgtataccagaacggacagttgatcgatattgttttcttcgatattatgtgtgataccgaggaggtgcggaaatctctggtaaatcatgatggatacccatccgatatcactgtagaggaggccgagtgatggataacctttctgttaaaatcgttctgtcggaactgagttacaaggccttgattcaagccttcgccttgcttggtcgaacgctcgacctagacgaagggttggacgatatacttaatcttattgcggatgagatcgctttccgcgacggcctgccgcctttcgcagacgactgcgataaaacagaatggatgctccgtcgatgggaatcgctcccggtggtatcgtacaatatcgggcaggacggaccgattgtcgctcggtctatcgaagtaaaaacggcatgaggggagaactgatgaccgtcagagtaggagatatagtggctatccggggcgacattcggaaaaagctcgacggaacgtgccaatacacgcccgaacaattggtaggtggtaagttcctcaagcatgccggcacgggagaaatatggactggccgagtgagtaagatacaaggtgatatggccaaggtgggaggggcttggcgcgggatcgaattctatgtgctcattagtgaaataaacgcttgacaacctgacccactagctgcaaaatagcacccacagacaacgaagacgccgataggcgaggagaaagcagatgcaaatgtttttcaaaacccgtacccaagcccgtgcaatggccaccaatggccgtaaagtggtagacaacggcgctcaagctgaaaagcgctgggctgtcaagctgaacaaaaaggaggctaagtaatggctaagtctgttagcgtagaccgcaagcggtccattctcgacgaagcgaaggatggcagtttcttcagtgtggagtttatcaaggcggacggcaccgttcggaaaatgacgtgtaaacgtcagatcaagtcggcgtatgctaacggccagtttgctacccgcaagcccaccagcgctggcaagccgcacctgtataccgccgccgaggtgctgaacatggaagagggtaaatccgctttccgcactatcaaccttgagactctgacccgtgccaaggtaaacggaatcgaatataaattcgattaaaagcttgacagcttaggccattcgtgtagaatggccctcaagcaagacaacaacctaagaggctatacagtgaaacaaggtactgatttgatcgctaaagcaaatttcaccgcccgactcccgggagctaagcgggggatttcggtcaagccgggagataaattctgggtaactactccgtcctacagtaacaccgatttcgtaggcgtagcgaggaaaggcaaaacaacctcctaccttttcactgctaaggatgtacaaactcttttcgaagcagtataatcttcagacccactcaaccaacgcttgacaatacaggagatttaaaatggcacgttctatcaaggcttccgacttcgattccgcttaccagttcgaggccgccaaacgttccgaacgtaaagaatcccgcaaatcgcgtgacaatcgcaaagcgagccgaggccgagctttcgacttccgcgacgatatctaagatttgcgcctagccggtgggccgattcgccggcaatcctaagcccattcgtcgagtggttttaggattctcaaccccagcggagataccaaaaatggttcgtcaatgcgtaccctgtcccgatgctcgccatgctttttgccttgcttggctattcgccatgccggagttcgccggtctgcccgctcaaaaggacataaaactctttaagacttcgggacagtgggcggtatgttatggctaggcgtcaacggctaccgtcgtgggtgcaggaccagaccgaggacgatactccactccgggataagatagacccataccttagcaagctcggcgaagtcgataagctagagggacaattgcgacgggtcagggatgcaacggacccggacgaatacaacgaaatggctaaggtactaaaagcccgacgccggaagataatgaagcaacgtgcccgggcctacggtctgccagaggatgagcctaccaatgtccaagggtacagcgtaccggaagaggttcaccgtagagccatcctgttaagcagtgtaaaaccttggatgttctggaccatcctgtctttctcgatttttgtgtggtttgttttgaaaaacagttgacaaggttcccgcctcctgtagaatggtcagcaagaaaggcggacaggccgcctagctagacaaaggacaatcgtcatgaacttcactctcaatctcgtttccaaaaacagcaaaaccggtcccatgcctgttagcacgtctcataacggcacctgcccggatgcctgccctctcaaggctaaaggctgctatgccgcttatgggcctactgctattcactggaaaaagctaagcaagggtgaacgtggcgtagagtggaaagagttccttcagcaggtgcggtctatctcccgtggcgacttgtggcgtcacaatcaagctggtgatctagtaggtcaggatgacgttatcgacggcgttgcgctaatggatttggtgaaagccaacaaaggacgtcgcggcttcacctacacacattacccgatgaacaatttcatgaaccgccagcacgtattgtcggccaatcgtagcggcttcactatcaacctgtcgggcaacaatgtagcgcacgccgatgaactggccgacctgaacatcgcccctgtagtgactattctcccgatggacgcggagaatgtaagcttcacgccgaaagggcgtaaagtggtagcttgcccggctgagaaaagcgacaaggtgaattgtaagtcgtgcggcttgtgccaagtggccgacagggagtatattatcggcttccgtgcccacggcacagcaaagaaaactgtcgatctcattgctaagggttaacacaatggacgaatctgtttacgcaccattcaatcagtgtaagatgatgggcctagaacgaaccgtgcggagcctagcggctcctaacgggtgcaaggtagtcttgtatcaggaccataagaacaagcatagaatcgtcatatacgatgccttagggcatggaatgtctggggtcatggtgcaagcggatggggaaattcactacaaggaaacccgcaaggctagccaagggcaaaacctgacaaggcaactacaagcccaactgaccgcatggggagtgaagtggtttccctctcagtatcagacaacggcaggcgcagcttgctacaaaggagaccggtaatgcgacagcttaacaaaactcaattcaaagcattaggcgctaagatcgacctagccttagagctagccgctactggtcgaggtgaactaatgaatggctacggctctacctgctacatttcaaacaaggctggccataatatccttcgagtgagctaccataactcccgattcgttgtgtacggtaacgagagcgtccgggttaccgggaccgccttgcaggcttggacggagtggaaaggcattaatctggcagccatcgcgtctgttagtgagtatgggtatcatcctaacctgagcatcggtcacaatgacgctcttaagactctcaaggctattgagagctaccaacgggagcccgtccagtgacggcctcctactccgtagacaagcggggacagcgctgggctgttatccgaacggaactcagctttcgaggtgaaagagtcaccgtgatggggttttgtgtagaccgggcccatgctctgaaaacggtagccaaattcaaagcttggcaagcgcaaggctggccctacactctgaaagacgacagaaaataaagcttgacagcttaggccattcgcgtagaatggccctcaagcaagacaaaccagccatcaggaggctagaaaaatgaaagctgtagctcagttcaaaagtgaagattacgcaagcggtgatagccgcaccgctaccgtctatgaagacgtctatggctgctacatcgtgagcgttttcggaactagcttgagcgagcccattgccttccattggggcccgttcgaggataaagaatccgcaatcgatggcgctaagtctgctatctaataaaaagggactacagaatgaaaatctccgctatcctgaaaaataaccttgaactttacggaccgatgactttcatgtgcaatttgatagaagatgatccgatcctaggggaagaggaggtaatcgaggctaagcggtttatcgaaagcctgctaggtgaacacttcactcttcacgctaagcttaagagtgaattgcgagaatatgacgcttactatcgcggcgacgccggtttcgggtctaaccgatgctttcaaatgcggcaattgtggtggaatactgtaatcgaacaattggaggctcaagggaaatgacgcaagctaattggtgcaaaggagtccgcatacttggcgggaagcgggacggcgagaccgtcctgtttaccgacgctcacttcagcgagtcgatgggtatggcaggcggcgaccctgaactggtggaagctctgcccatgcctgcggcgcttcgtttgctggtcaaatggaacaaactgtgccgacaaatgaagcttgactaccgctacgaactgctgtaggctacagtctcaatcagaacaggaatgaaccaatgtcgattctagctctaaccctaaccctttgctctgctgtccagtgtgacgactacattatcgatcacgcgctcccgggacaagccgcagagtgcaatgctcggctggtggaggaggccgaggagtggggcgatgcgtgggtggcgaccaatgctgacgcccggctgacccgataccttagccgattcaatattcaggttgacccgcgctttgttttcgactacgattttacctgccaactgatcgcagaggatgaactaccatgatcgctccgcatatcaccaacaaacaataccgtagccgtgccgccgtcatcatccgtcgagtgaaatactatgaaagccgctggcttcgtactgtagagtttttctcaggcgcggccgctcagaacatcgcagaacgctttgcctacgctgggcatgccgaagagcaactgtccaaacttaaatccgagtttgcagccttcccggtggaggtgaggctagatgctctaggttggataaactggaatactcataacgacggtctgctagaggagtggattcatcaggatagtgaccgtgccatcatgctagagtatgatagcgaatcgaagcggcctgtagcctgctgggaaaccactgtcgatgctcttcccaagctggcaatgctgtaaaatattgcccgtcaggctgaaataatgcttgacgggcgtttttgtacctgtagaataggcctcaagaaaggaaaacagccgaaaggctcaatctgaaacccggagatcaataaaatgctgctagttcatgggaccactgcaaaaggcctgaaagctatcatgaaccgtcaaggcaaggagggattggccgcaccttgggacgtttcggatcatgacggaatgtcatacttctacaacgtgaacaaggctatggaatggcacgatgaagaagagtatgctaaagcggaatgcattatccgttgcctagaacaggctcaattacagcaagctatgatggccgaaggcggtaaaatctacgctctggttgtcgatatccccgaagagtttcaggaccgcgtagaagatgattattcgtgccctaacgccagtaatgaagctagctgttttccagaggataactttgatccatcatggattgtagaagtgtatgaggcagaggtgagtgtatgggccatccctttcatcgtagctggagtctcaggtaattctatgttccaatcccaccaactacctgacaaactggtggcgatagcgaagtcggtggcgcagtccagtgacatagacacatacgaagctttcgagatcgaccattcacagctcccgctgtcaattctcgaacatttcaaagataacgcttgacagtctagccaactagcgtagaatgcctagccaaggggtgcataagcgccccattcaaaaggatacagaaaatggccatcgttgatcgaaccgcaggtaatgaaagcccgaatcactgctacatcgtcactggcagcattggaccagagtttgagccgactctgttcactacccatgcgctggcaaagaagtatgctgagcagatagtgaaatacggcaaggcaaatgatgttttcccgccttttacgcctgttatcgagacccggcacaaggcagatatgaatcggttcactgttcacaacaaaatcccggaataggagataaatcgttgaaactctctcaaattttccaagaaggcctcgactacgctatctttcacggaacgccgtggtatatgtgtgtacgtctccgggaactggacttgccaattaatctcgacgacgtgacccgggacattcgatctatcatgaatgaagccggaatgacccggcagtttatcggcgacagttgggatggcggcgtggacgaccacttttgggaaactggcatggctgatgcttatgtgatgacgtggcaagagactatcgattacgggagccccgcctatgcaatgtgggtgcaattttggttcttcgtaatctttgacttagcccgaaaagggcagtagaatagccggcagataatgtgatctaagggacgatcatgaaagacaagactgtagtttatcgaatcgagtgtaataacggcgagggcccttatgttaatgggtgcatgacgaattcgtcttccactccagaacggcctgtccctgagcacgacgggataccggatgttcgcgattttgagttcttcgccttcacgtcccctaggcagctagacgattggtttggcgacgaatacgatgtactatctttctattctaccgcacggatcagggtctatgaggtggacaagcaacatgtaagggtaggcatccggcaatgtgtattccgcaaggcggaagctgattgcgtccaagaggtgagcatagaccaatgggttagcatggtgaaggctggaatgctttctgccgtcgtcgcacaagctctatctccggtcccgcctgagcagctatccctagacctagagggcgatccgtcctgcacagcttcgaaaaaaaattttgaaaatgttcggtttatagggttgacagcttgagtcattcgcgtagaatggccctcaagcaagacaaaccgccggcaggcaaaaccacaaacccggagactcaccatgaacaagccaatgaacactttcgcatacgctcacttcgtagcacgtcaagacaaagctagcggcaccagcctgccctacgcaacgctgtttcgaatcgcccttcggatggcctatcgccagcccggcgtccggcagtatgactactcctcccttgtcgaggatatcaagcgccgcgaactgatccaaaagcgcattcgtgctgaaaaggctgtagttatggccgctgttatgcgtgcaatccgtactggcttcactgttagcgtgaaagatggcagcgatggcgagtgggtagtgaaaaagtctaccgatatcaaggaaatctccgacagcctgcaatctaccgacgaggatatcatccgcttccgcaagggcgacggcccggacaacatcgtcggctctatgtgggcaatctacggtaacagcgccggcgaagtgatcgccgactggaccgaaaatgccaccatggccatgattatggctcccgcagaacgtaagatggaaaaatacgctgaaattgggatttaatgcttgacggggcccgaaaagggccccataatgcacccataccaaccaagcaatcctagagggcaacaccatggctacactgattatcggcaacgtaaactaccataaccatcgtctagtcgatgaaatcgctggcgatgctggctacaagggtgccgcccgcttggtggacgaatgcactcgcaaaatcaccttgctagcgccttctggaatttctgccatcgacgccaaggagcgtgctgaagtcgccgcaatgattggtgagtatcttctggcaggattcgaagtttcgattcagcactaacaccttaaacccggagtactgacaatgaaacgccaatataccgactcttaccagtgcaaagcaatcgacggcatgatctctatcctcggcagcaagaaagttaccactcaagtgccgccgtcgatgaaagcctctcgaaataaactgctgaaaaagatgataaaatacgtcgcccgggcaggatggaaaccgtaatcgactaattatcacagccccggcaagccggggctcacaataggagataaaagcatgaataccctgattatccgtttggattccgcctacagcgttcaaactgtccgtagtttccttatggaagctgtagagagtattcgaaagcatatccgggactacgcggttcatgacgaatacgattcgggattgagcccggtagcacccaatcatcgacttgcaatcgtcaccttagacgaagattgccgagtgtttcacattcaatgcgagtcacctgatctttatctggcgaaccctcggatcgtgtttactgatgttgaaagcccggcatataccactcccgtgaacgagatcgaagagtatagttacatgaccgcatggcagcatatacgccaaaaagatatgacagcaaaagactacctgtcggattggtctatccttttcgcctcaaaggagaatgccattgatatcgacccgcgccccaatctgaaaacgcaaatcttgcattaactgagggagctaggatgaagcttcgaaccatattcgaaacctacgattgccgagttaggtttgtcaccataaccggcgtgtttgtggaatctcaaattgtgcggagtttcggtcaagctcaggagattgtatcactcctctgcaatcccgcagatactggtatccgtctatccttcttcgacgaagaggagggctgcgagtcgatcctctgccgattcaactacaaaggagaaatcatcaaatgaataacaagtataaggataacatcattgcggaatactgccatttcgacggcagacggccagtcctttccttggcggcacgatgggtccaccacgacagtcgcgttgtgaagctggcagcgctctttgcctgtgctggctatggccgtccttacaaggactgtattggtgcctacaaggctgctaagcggcgggaaaaggatatgcgagaccccgccaaatggaagcttcagcgggaagccaaacgagctgtgcagtggctaaaagctaccatgaacaaacgcaaataaggcagaaatacctgttgacgtgagactaaagggttcctatactgtgcccatcgagacgcacaaagcgtctcctaagctagagggactagcaaaatggcaaaggcaaatctgaagttctcccgcattggcaatgacggctacgactacgcccgcagggaagacggggtttggtttgtcagggaagggtactacgggcggtacggctgggctaaaaccaaatggactcaagttcaacccggagatggcatgactatagttaacgcctgcctgaaggctcacgaagctggaagctccagcacatacatcggattcgggaatctggtggtattctccgacgggaaggggctccgtttaccctgaacaggaactcaaataaagttgttgacagcttaggccattcctgtagaatggccctcaagcaaagggaatcaccctgagcaactgaataggtaaaagacgatgcaagcaacctaccaagccctgaaaactctgcgcgatgcttgtgaagctgtcaaggatgaaaaaggcaccatcaacggaaacaaattgaatgcactgcgtaacaaggctgtcaaggaaatgcaagctggcggtgaaacctactctgacgccattagcatggctcacgacttgattaagaagtatcgcaagtaaccataaccccggttcgccgggtcatcacagagcatgaccgaggagacaacatgaataactcgcctgtagttgtatgtcttaagtgcggagccgtaaatggcggacagagcaaacacaatgttgtagtagctctggggaagaagtggtgcggtcattgtgggtccaatctcgcaacccttcgtcgctaaccattcactgagacctaatcgaggagagatcatgaacgccactctggcacgcctacagaacgaacgctgtgcaaccctccgcctgatgctgctgccggaacatcgtggataccagttcactggccatccttgggccgagcgaatccgcaatctccacgatgaagcccggtgcatccgcagccatcactaaaccgcactaatccattaaagctctaacagcccgccctgtgcgggctttgttctatctgcgaaagcgacagctttcaagtgtaattaacatgtaatgttgtaacaccctgtagagggtaacaccagcatgacaagatagaccacttgtaacgttaacgttacatgtataacagcatgacagcggaagctgtatgttcacattctgtatagataaccctatcaaataaccccacaataacctacctaaaacctaccggtttaaagcggcctgataggccgtagatgaagcgatagcttcgctatgttagtctgcaccgtcaaggcgaaagccttacagcatgaggcttgtaggaggttttagaggcatatgcgattagcataggatgttggttgttttgagtagattttgggtataacccctttccgcgctaccattgtctcagtgatgttaagcgacagcttacatccgctctcattttgcaatgagaattgcgtacagttcatcatgcgcctcagaagtgacttcactttgcatgcggatgcatgctatagtataccctgtgatagctccgctatcctgttttgcatggcacacgaattgcataagcatgacaagggtaaccctcgaaagcggagctttcaaagtggtctgtgaagtgtaggctctaccctttagtatattgcgaccggaagtggtgacactgaaaacattgactccagcccagtaaacacggtaaactaaaaggtggatagctgccgctatcgagtaaccaacattcacacaaggaggcacaatgacaagcaacaatcatgccaagattcacatccattacgctaagcaaatctactacgccatgcgtaaacgtgtcatcgcaggcgatgagatatgcaaagaatgggccaagcccaaaacaggctttgaagcgttctatgattgggtggtgaatgtgtcagggtacgccgtaggctaccgcctagataagaacatcctctacccgggaaacaagctctatgctccgcatacatgcgagttcacgcctacatacatgcacactctattctccaactgtgacaagacaagcaataaccgtgccaatacgtgggatagctatatccctctaggcgtccgcctagcacgctatgacaagtacgggatgcctgtatacgttgctcagtgtaggacacttggaaagcaatctacccttggatcgtggaacgatccgatgcaagcccatgcggcatggcaacatgccaaggtagcagccatcctcgaatgtatcgatctctatcagatggaggatgttcacagtgtaaacgttgttcaagcgttgcttgagagagtggacaaacttggcaaggatattgcacagggaagagagacaacccttttgcaatgatttgatggggtcgatggtcaacccttcgagagtgtcctatcggggtgcgagaactccgatagcgaagctatcaaacgtatatgcatattccatgccaacatgtggaaagatttcaccgggcagggcgggagcccgttggcattagttttgcatagcttagctgtcgctaagaaggaaaaccctcggccacccattattttggatttactaagggttagggtagcga

SEQ ID NO: 9 - DNA, 92765 bp, Myoviridae Pakpunavirus
  misc_feature (1)..(92765)
cagcttacatccgctctcattttgcaatgagaattgcgtacagttcatcatgcgcctcagaagtgacttcactttgcatgcggatgcatgctatagtataccctgtgatagctccgctatcccgttttgcatggcacacgaattgcataagcatgacaagggtaaccctcgaaagcggagctttcaaagggtagagactaccctttagtatattgcgaccggaagtagtgacactgaaaaccttgactctagcccagtaaatacgttaaactaaaaggttgatagctgccgctatcgagtaaccaacattcacacaaggaggcacaatgacaagcaacaatcatgccaagattcacatccattacgctaagcaaatctactacgccatgcgtaaacgtgccatcgcaagcgatgagctatgcaaggaatgggccaagcccaagacaggctttgaagcgttctatgattgggtggtgaatgtgtcagggtacgccgtaggctaccgcctagacaggaatattctcttcccgggaaacaagctctatgctccgcatacgtgcgagttcacacctacatacatgcatacactcttcaccaactgcgacaagacaagcaataaccgtgccaatacatgggatagctatatccctctaggcgtccgcctagcacgctatgacaagtacgggatgcctgtatacgttgctcagtgtaggacgcttggaaagcagtctacccttggatcgttcgacgatccgatgcaagcccatgcggcatggcaacatgccaaggtagcagccatcctcgaatgtattgatctctatcagatggaggatgttcacagtgtgaacgttgttcaagcgttgcttgagagagtggacaaacttggcaaggatattgcacaggggaaagagactacattgttgcagtagatcgacggggccatggtcaacccctcttagagtgcgagtaatccgatagcgaagctatcaaatgtatatgcatattccatgccaacatgtggaaagatttcacccggcagggcgggagcccgttggcattagttttgcatagcttagctgtcgctaagaaggaaagaccacggccacccattattttgaatttactaagagttagggtagcgaggtgggttcgtggttaagtagctcggaaatagaaccacaactcccgaacaggatacactcggacgtagggccacactacatcattattttcccagccatagagtaaacgcactcttcaagtggtcattatttctgggaggggattggggtcgtgcatacaatagcaagctccgcttgcacagggagaatggccaatgcaaatctataggattggtattgggaataagctgacaacagctagaccgtaactgtgtaaaagagagccccgggcagcaaaagctgcccggggctttttgtctctactgattgtattccatgtcctctgcttccaagcatccctgcataaccttgcagtactcttcgttaatctggtccatgtactgcaacgctcgttctttgctctggtcaggactgaacccgttgtgacggagaatcttgttcaaattctcatcatcccagaagtctctggaccaagcctcccaagccactgctttcagactctttatgcacccgatccgggctggataccaatattgctcagacattagaccctccaaacgcagcaaacaccccttgcttagctaggatagtctttagctcctccagtgaaatggtctcgtctcctacgaccacatacttgtctgccttccctagagtcatcacacacttagtctggaaggtaggccgatacaagtcatacacatcgggttgccacttgcttcgcaggccagttccgtagctaatgaaccggtcttcgggatgatcccggatgtataggcaccggggactatcatctggcccatctacggagatagggtgttccatccactccctgatcttatcaacgacgccctctcctaccttcaattgagcgtactgacagtactcaaggaacgcatcaaactgttcggcagtgaaattgctgacatcgatctctttagttttcattctcttcctccatgtctgcaatgatttccttcaacgcttgaagcgtgtaggtgccatttagctctgtagtaggaccagtgtcacactcatgaagcgtgtacgcggtcactttcttctcagtgacgaaatggaagtctacccttcggaagtcgtaggtcgatttcgagtatccaatggcctctttgagttcttcctcgtaccacaggaatgtcattggacttccgtcgcttttacgagtgtagtccagcagattatctccaacccacagtagcacttgaaccttgtcgtacatgaagccgtttccgctcccaaactcgataccataagccttaaggtgctgttgtactgcaatgttctcttcgggggtcttcacaatagtgtaaaacttcaccaaacgctctttcaatttcattcctcctgtctgtgtttttatgggagtgtaaaacgttcccagtccattgtcaagccttctgtggtgatagtctgttccagacgctctctagctccttttagaatgatatcccactcatcgccttcttggacccctacatacttctccatcatcagcgcacgatcaacaagcccagctctgtagttctgtcgctcttttctacgcgatagcactcttgagatatggtccttcttctttgccaacacgctgatagctttccttgccataagagttgcatactcgctctcctcggcggtcatccattcctgatacagcagccctagacgagtgtcatgctgtacgagtggaaggtctttccatatgatacctactcgtccagtatcagagacggctttccattccagcgtagtgccggtcttatagtcggtgatctttacattctccgagttagattgagactggaaagcgtgcctccagtctcggtatacagtccaccgtttccagtcgaagaatgtctcacagatggctttaacaggttctccgattttaccctccagttctttcaggcggttctcctgctcagcactcatgtatttgataggtcgggaggcggggtcgtagcactcctcgacccgggcctccagtagtttaggctcctcgttccgctcttcctctcggaaccatgcgaacagcttcttaaacatattcagtcctcctctcctgtgatagctaccctagtcagtctccacacttttctaggtagactaacgaggaatagcatagccataaacggtacggcgataggccagaatattccagctaacaccgctcgggcctctttcttacgcctctccgtactttctcccctccacccaagaaggggtcgtagagattcccatacgaacatccctatcacagagtagaacaataggcagaccactccgacgactatgcatactagaatgagaagccctacttgttccatggtgcgatcctcttaagtagtttacggctgttccagatagacagagcccacttaggtaacaacaccactttcaaaacgctgtatgttgcgtagagtagcagaaagctagcatacactgtgaatgtaataggccatagcagtcccagtacaatggcaaaagcctcgataccctctctgtgatctttagtcgcactagctgggaagttatctttgaaatactccgtgatacccatgtaggtccacatgaacacaattccccacgcgagcgcgaggacgaatagcattgggattatctccattactcccctccttttcgaatcaagtcgaagtaggcccacacgtagaagttgcaccacgctctgcctatggcccagccttcccaatagtcttcccagtccttgttcggagggttattctcgaacatggataacacgcatgaatcagctacttcgtccaagaggtgcattaccgaattaagcggcccgattccaaaggtcttatctagccaccccttaaatcgtccaacgtctgagacggtgacgctggagtcactgcacagtgccaatctctccagaatgtagcacatgtaaggctcttcttcgttctctaagaatgcccgcatgccctccttgattagcggtgcaatagaattagagttcattgttttcctcctttcgaatcaggtcgaaataagaccagacataaaagttcacccagtttagatcagtatctagcaggtaattacgatgaagaagagagataactgaatcccacgacggaatcccatgctcctctagtagccactctctgaatgacctatactctccgtgggagatttgcccttcttctgctaggtcgcttagaatataacacatatacgtgtcccggtcgtttaccaagtaatcttccagtcccatctttatcaactctgcaactgatctcattgtttcctcctctgagagccccactagggctcgaaatttttggttcgacctccggtcaacacatcacaacccagttgtacaggtcagcctcctcataagctgatgggtagcgattgtactccaagaagaacgcatggtcaatagctgagtatttggttgcgaaactcgtaatgtaagtcagaaacccgttgtcctctttcctgaacagggcgtattcttcagtaccgtccttaaacgtatctagcgagatagtatacttatcgaagatcacagcatttcctcccggctaatgtagtagttgtagtcgtcctcttggacgaggaacgcacgatagaagcctttctcaaagtctcccttgaccagcaccagattgccctccaccttgcatgtatagatatacatggtgtttgctactcggataacaggatcatccccgggacgaacatccagagcagccgacatagcttccattggcatgcttgtcaagtgagcaaccacggcggagcagtattctgcgtcccgtcccgaggtatcctctgcataagcaggagcgaccccgcatgaatgcagggcaagtgtaaacgcaacggctacgagtttcttgaacatactaaccctcctcttggtctgtctggggaacatccggcttggggtagacgaatgtctctggatacttcatgcatcttagctcatctttgcagaacccgtcaatcaatttctcatgtgcgaattccgcagccttgtagtagcgattagcctgtcttgcctccactcgaaggaggtggcttatcgtgtgagcgttgatattactaaggcttgcaaaaattgtcaagagcttctttgcagagagggggattgacctttcgtcaggtctgtaccaatcaagtctggccactccttggagaacgtcgtccacccatagagggtagtctccatcaagctcgaccatgacttcgtacatttcaggctgaacagcgttgaaaaagaaagagggctttcgccctctgctggtatctagaggaggaacaagccccctctccaccttgtgaatcaaccgatcagcattcgcccctatccgagactttagctcctcgatctcttcacatgtcaacatacggagggcacaccttagatttctcgatagtgaacacgccttcgcatgtcaggttagcaggtccataccacttgaacatgttgttgatatcgtatcgaatcaactggcggaacttctgcccgtcgcacatatccacgtcgaaccacgccacgacccatctgacgtaatcttcagggtcgttctcttctcgccacctgcactctagatcaacatgactgggctctagaacgtaaatgtcttcgaaccctgtactctggttgttcttaagtcggatgattcgagcgcgaatccattgcatgcacctgcggtttgggtctgtgatatcgcagactaccggaacctctggaacctcaactgtatacatgattgtacctctatttgttttacaagaacgccatgattctgtctctgtctgcatggcggtacagattgaagcaaggcacgcctctagaggacgccagttgccaagcggtcctagtcccgccttctggaatcccgttgtggtctgtcttgctccagcacaccaagaacttgctaggcgtgttgagatcgattcccagcacttggaaaacgttccgagtgtgggctcgtcttgcgaacgggcttagaacggacctcccgtcatttctgacagagttccaagccggatgaatttgactggcaatgcctttagcttcttcccattcagccggcaactcctcctctggcaggatggtagctccgagcgtctccgttatctggtactggttgaagccgggagacggaagatagatttctgccgtagttcctccattgttattggatatataatccagccagcccgattcgaacgctgagtccgctcccttcgctcctcctgaccgaagaataaaaccttgttctgccagtttacggcctacctctcgaaggatgccccattctctgttcggagtgtccctacttccgactcctgtgtaatacttcataagatcaccattttggatagctcttctggtgttacccattgatgccggtattctccgttcttcgggttagaatattccaatagaacagggtaatactcgtctcggtaatcggtgtctataacctcgcagttccaacctacagggataggacaagaacgccccttgggggccatcttagtcccaatagacaacctgccttgactagccgcctcattgacgcttatcaggctgtatctgtgttttaacgcttcaactaccttgacttggaggtctaaaagttcctcgattgtaaagtggcttacatcgattgtcatattactccctcccttccagtttcttgaattctttgtccagcttagctagatgcttatccaacttgtctagctttttatcctgataaagctggaaagcctccgagcccggggccaaccaagtccccttatacttaattgcaccccggatcatatctcctcctattacagttcgtaaacgtatacctgaaactggccgagcgtctcctcgataagaggctcgacattgctccagtcctctccggctaaaccgcagccaatcttcggcagacctacacacaactccgaggtaggaatcgcccgagcgtcagcctctgcctcaaggaacagagacatagtgtacagggcttggcccagtgcgtcaagctgagtgtagactcgtccctcttctcggccatagttgtactgcccgtacagattgtaaatcgatccatactcgttaattgtgaaggtgagggagccgagtttgcctcgatcccctttcaccgttgcttgatctgcctcgtaggcctccgggaattgctcccggatttgcttagcaatgccgctgcccatggtgttgaagcaattagcctgatgtgcaatagcgtgcaactctttgtttttgaacgcggcgataagatcgccctttcggtatttaatcatttgaacctctctacacttgtgtatctgatattcaaaccttccgcatcagctctgatcttatcgtacatcaagtctaatgctgcgaatggagaccagtaccctttctcccagattttaaacttgaacaatctatgtcctttattctctggtcggccttgctcacagaaggttgtaaaataatatttagccaacatcctcgcctccttacacgccgttcttaatccgataacggatggactccagatcattgttcttcaaatcttccgtgtcccacttaccgtctttgaagaacgtccgcagatgcccggtagcttcctcttccttcgacacatcatccttcagtcggaggaaccgtccattgtcttggtcccggtacactttcaagagacctttagccgacttcttcttgctatcagtcttggggtctttgaagattgcaatgccttctccattcacctcggtgtaggtggccttcactgcgaacccgaaggtgtctcgggtattgcactgataggtgtaactcccaactccgaagaccacgttcaaggatgcgaaacctttctccttgagccgctccaagattttggctgcccgacgtgtggtgatcgaatccccatagatcaaaccgatatgagaatccagcatcttataaccagcttcgtttacagtaccaccgaaggtttcccaaagaacttggatagcacctttcacctgagcctcgctaacttcctctagtttatagccaactacatactcgtactggtcccactcggttggaatgaccttgaaatatttatcttcgaactctagaacaaaagcgtcatttccgttgaccgcatccatgatatcccagtgctcaagagattcaacaacttccacatcgcccagtccgcagataacctctacaggatcgccagaatcgggacgaacaaccagcttgccgtcacgttccatgatctgatccttgatggacggcagaatgtcagtaagcacgccccagaagtcgaagctgtctgccacgtaagacagaataccactcgggaacttacccatcagttcaacaaggaatcgacgttctgcttcctcacggccacctttaccttctccatccttcatttctttctcaatgcggaggatgttactagtagctacagcgtgttcagtcgcaggaacggagcaagctaccaaaccagtcgcgttatagtagtcctcagcataaatagctgctgccaaggtgtccgaacctacgaacgaggtcaagtgaccaacaccgctacgggctgcgtcttcgatcccgctcatgccccgggcactgaagtcgtggaactgtacagacaacaggaagtcgtcgtagcacccagtgtggttcgcgtagtaccggcccatagctgcgtattctgcggcaatggttgcgttggttgcggtcttccaagtcatagccgaaatcagggtctcatggtagttcaccagccagtagaactcaggcagggtgttcttgattgtgagaacaggcacacccatcggcacactgacgccctcggtcaaagacttaacctccagaggcagatagccgagcttgtgaagggcgcgaagctgctccacggcttccatttcccggccaaaatagccagtcaggaaccgggaataccggccaacggcgttctcttcttcagccgcgaagaagccttcccaagactctacgatctccatccaagcggcccgtccgccgacccacttgagagtgccgtcgtagaagtcggtggcatgcgtctttcgataaatcttatcggagcgaggggtcaggttgctatagacaagctgagttccttccgagtacatggagccgtgtccaatcttgtacccatcagtggaaagatgcggcagaattttcatgttatttcctcctgttgtgttgaataggcccagactacatcaatctgggcctcctgtcaatattcgacttcttctactggcagcgtcagcacagggtagatgcatggaaggcgcagcaatggttgcttcttgctgtggaagtcttcccaaaacttatcgtgcatcgtcttgtaccgagcgtccagttcctccttggtgtcgaactcctccaccttgacaaccctcttctctggagccgaacgcttatactctacaatccagatactcaagctcacaggcgttccgccttggagtattcaaccggaatgacagtcagcgcttcgtgctctttttgagggagcgtatccgaggtgtagatgcatccgaaggaatccagcaagcagtcgatacccttactgaagattccatgagtgacgaacaggtcagggagcactttactgtactctcttagggccttagacacgcttcggaatgtagcacctccgtcacagatatcgtcgatcaccagaagcggaagttcaggatcgatatccgaaggattcagaatttcaaagccttcgattttaccggtctggagatcgcgcttcttattgcaacgaattacagcggctgctccggccttctttgcaaaatcctcggtccgctttgttgctccgatatcaggggctacgagttgatattgctcccactctgaacggctcagtaggccaccgaagaccgaagattgacggacaacttcgacgttgttaatcaggtgcagagttgcgtcgctgtgagggtccacaacgataactcggtcatatccggcagagttcagcatgtttgcaaacactttcaaactgaaggcgtcgcccggattgcaccgacggtcttggcgagcatacgggacataacccagcagaagagtcatgtgcggattaatcatttctgctcggatcgcctcggtgacgttgagaagagccatgatatcatcactattctgaatctgagctttaacgtttacgaacgcatggctttcgatgccgcccacattaacgcccacttcgccgcccgggaacgtccacacttttgcctcttgccacggacggctcataacaccttccatttcctgaaggcaacctacagcataactaatcatacatcctcctcacagtttcacagagaagcgattccgcattgcttccatcgtgctctcgggaacatcgtgtacagacttattcccatgacgattctctacaatcagagagataacagtgtagccaaactcttcagccatgtcaatgtatggtgctacctctcgctcccgggtactagtattggatacgataaccgcatctagtcctatctccatagaccgtcgcgctttgtccatgcactttttgtgagattcaactaccctctcagctttccacacatacttgccgaactccatttggtaatcgtccgcttcgcagatagacgcctgccggcctgactcccaagttttgttatacagaatctcggcaagagaggacttcccggagcccgggagtcctcgaatgatatacatgatcttttcttgcatacttcctcctttaaattcgagccatatcgaagtaggtttcgatcagaagtcgtcgctgtgcatcggtcatttctgagaaccgagcctcatccacttcatttaccaagaagtctaccagaggatagaactcttcgtcaagcgtctgcttgaatccagccgggtcttggtacatcgcattgaccttcttactacccatcctcatgataaacttcttgccgaggtagtgagttgacttgcacttcactgtccctagccctgtttgtaccatgtaaccttctttctcacaagaactcagaagaccctttgcatgttcccagctacactctatgtgctctggacgaagaatctttacagaactgtggtccgttacacctagggcgtgagagtcaagaatatattctgaaagctggcccccagtgaagatatcgcggataccgatcaaatatgccccttcttcttcctcgacaatgtgagggtcgtctggagagcatatctcgaagttatatgtgaagcctgcgatgtaatcatctgggttattcgacacatacttctgaccaagggcaacgtaatcgccggtcaatgaccccgtagtactgaagataagggagccattgtgcttagtcacggagaacatgaatccattcactttctcaatcagccgcacacggaatttaggatggaggaaactcccagcaccattctctcccagattaaacaccttctcgaaggggcgtacaatacaatcaccggagtgctggtcaaatacatgaccccgtgcctccagaaggagcggatgctcattccacaggttctcgtagaacaccttccgggcatactttataatcgacataccgttgaagtgcttaacagtcaccagcttattagcgatcaggtctttgtacattgcaatgttgagattaccttccatcctacttctccttatttcaattcgacaattgggcagaatttagccttctttgcctttagatacgataccagaatcccatccttgctggacgatttactcgacataaagcgagagaatcggtagaaaacccacacgccataaaagacggctatgattccaatccatacaaaccccatgacagccagagtcccacctagaacatatccggtaagtggaccgagagccagagaatacaatacagagcctacaacagcagcgagcgctacaaccgttaacgccagccacacgacgaggaatactgtctgccagaaataagagcagagggttacaatttgccaaccgcttgagatagccgaatagaccggggtctcgaacgtacgatggagccgcatatgccacgaattcttatcaatcttcatgcttgttcctccgggaagatgttgaagttaagtacgttatgctcttcaagttccatggaggctaccatcttataacctccgagcttgtgaacgatctccagtatactctcaatagagaatttgtcaacatgctgcttcatcagattggagattcggctctgatgggttccacaccgctctgccacttcccgttgagtcagcccagactgagtgatgtagtgtgcagcaacaaccattacagttttcttgaaatccttgaccggatcattcatgttagtcctccttattgctcagcgttactttgccatcgaatactcggaattgagcgatctcaaactgatccgtccagcgggcgtcctcgaaagccactccttcaaaagtcccgtcttgtttaacatcagaagtcatgaggacgataaaaggaactccgtcgtcatggatcagttccaccagagtgttagctttaggtttaacatcctccttgtcacgcgaaatcaacacattgaccattctttcctccttttatttatggtggtctacaaccacaaactcttgctctcgcatatattccctcacttcgtcgtaagagaatacctgatgatctgggtgattgtcaatacctacatcaagcctctttcctttggaaggcaagctgccgtgagtgtggccgtgtagatgccaagcaccatgatgagcagtattccacgtctcgaaagggtagtggcacatcacgatcttcactccgtcaattcgaatctccttgtactcacgaatgtcttctacgtgagagagattgctagcagcgatcaacttccacagacgagagtcgcaatggtttcccttcaggaaggtgatacggccattcaactgtttaatgatctccagtacagagtgcagcttgttcctgccggcgaatgcgaagtcgcccaagtgatacacttcgtcaaaaagtcctacccgggagttccaccgagaaataagctcctcagtttgctcctcgaaagtccaaggcctgttgcagtattcgatcacattcttatggaagaagtggagatcggaagagaaaaatacagacattatgcctccttttcaaattcataaatcttgttgatcctgcggatcagtcgaatagcagcgcctcccagcagatgctctcgatccggtttcatatgggccattgccttgaactctgacagcatatctcggcgttcatagtggaagtctactacccagtaggtgtctgcattaatcttaccctctcggtacaggtgcccttcaacaccaagccagtggtctactgcgtctttcttcagaagctccttcggagaccacttgtctacaccccgcaacttctcgaagaaagagtaaggacgaaaatagttgttgatggcttcctctacagccgactcagcctgcaatttaatgaactcccatcttgcaagaacttctttaatctcctcggtggtgaccggggtgtagctgtactgctctttatattcattccacactgtactgttctcctacatagcctttgaatttgtcggaacgagttgtcttcttccgtgccttgttttccagaactgatgcctccctttcgagcatgctcagttggttgctatacttcttgatccgcttcgagttaccactcatcacagaatttgtaagatttgcgatagtatcgcagattttcacttctcttgcaaccggatgattacggcaagcttcgatatacttacggtagctctcagcacggttcttatcgagaatgaccaaagcctctacgatgtgaggcatcacgcccatggactccaagtcttcctctgtcaactctgtatcctccagaacgtcgtgcaggaagcacacagcgagaagagtgtccatgtacggaaggtcggagaaagcctgacccgggtccatatctttaggagcgttgcgagccacgcagactgtatgcacctgattcagatggtaagcatacgggaagttggtctctccgtaccgctgaccttcgtgagccgagagtgcgatctcaatagcgataccaagctgagtgttcatattagtctcctttgtagaatgtgtggttgcctatcttgattgtgcgcttgtatttcctagcccaccgaggaagtttgccattattagcccgtctcaccttcctctcgttgaggtagtgatcggctcctctcgttggatcgacagtatacccatatagggcgttgtatgcaacatgtttcgctgcctcccacttgtcaagctccttgacaccttgccgcatactcccatcgcaggtgtaggaatactggcacttgaagtagagcactccggctactgtgctcggccacctgtcgtgcttcattctgttcactacggtatgagctacagcaatctgaccgatctccggttctccccgggcctcgaagtatacagcttcagccaacaacctgcaaggctttctgtactcacacaaggtgcgcttgctttctatgatttgaccgggactggcttggaattccactacaggctccgtgccgtattttagacgagagtattccatgtcgaggaacatcccaatgaaggctagaaggatcgacaaaacgagagcttctaaggtttccataacacctccttagacaaagaagcccgccttgtgggcgggctgtatatcactcggctattatacttcagcccaagttgtaacgacgggcgtagtctttgttggggaactcgaccatcatcgactgaatgtgaatgttgcctttacgatccttctggattttggcatttttcacaatcttactagcctgcgcctttgccataagctctggacttacaaccagatcgatgaattctgcactccgatacccggcaccagccggggcccagaagccgtactgggtcaccgtcgatgtaggtacaaggtacaggttgtgcagacgcacagcagtgttgaaactcagcttgctgatgtgcttcgcttcccgagtttgggtttcaaaacacccagtcgtgtagttgaatttgtaagtgagagcatccatgaactgaatgacgcttcgaatctggatagcagaagtatccaagagctggaactcctcagccgcgtcgattgcagtggtcacgttgacagacttagcgttgaacattttatatcctccttattcttcagggacaaatacaccgccgattacccggccagcgcgaattagtttaccagttgggaactgagcacgcaaggtctttttgaaacgactttgaatttgcacagttagccacttaccccggtagttctcaaaattagtgatctgatccttgcgttcgtcaaagtcaccgtacgtcacctcaagcagctcttgaggtacagggtcaaacaccaccagaacagcgttcccattcttgtctaccacgtagttcacgatctgcatttccatatcgaagaactctttgtacttctggagaccactagaacgtttacctgattcgtacagtccttcaggactccgccacatgataccttcatagcctttctgtcgatacacatcatgaagacgtttcagttcttcaaaggtggagcagaatacgtactcgacgaagcgaattttaccgatcccggcaacagtcgcagccttgaactggaagtctaccagacgctccttgaatgtcaagccttctttcacgatatcgaatacgtgaaattccatccgcttacgaagaccgtaaataaaggacgtgctgtccacttcattcaggagacgatcatactcctcctctccgttctctagagcgtaggcgtcaagagccttctcagccttcatccacttatcgtaggcatcctctcgcttgaccgccgagttgatatcctccagcacctcaccgtggacgtacagttcgccgtcccacacatcaccctcttgcatgatctcttcgagttctttgatgatgtgcggtacattgtaaggtttacccatgcgagacgctagcgtaactacgccattggctttcttagccatgcaacgcaggccgtctagtttaggagagccatacccctctttgtatttagcgggatcaagcggttttgcgagcatagccataacagggagatcgttgagttcttccttggctgcacgataacccttgtccaactgcttgctcaccttggactgagcctcagacacggcctgctcctctacagagcgtttctgcttaccaactcggatgttggtaacctgagaggtcatggctccatgttctttgccgtatttcacgacgatattgaagctaccgtcttcctctccaaccacctctacagtccactccttgaacccgcctttcttgtcgagcccatatagtcgttgaaaataactcattgatcctcctcgtatttgatgacaagaacatcattctcccgtaggtgcctaagaccctcgtcgagccgatattcgtgcttatagtacactactttgatcccagcttcaaccaccgagatagcacaatttttacagcaagagtgagtgacgaacagggtagccccttgggcactctcagggctgcgtataagagccctcagtgcgttttcttcggcatgcctcacctctgccttggttactcccgtttcgtcctccagcggcccgtttaggtgctctggaagggcattatacccgcaactgatgatacggttacgttttactagaactgcaccaaccttggaacgagtcgagtcgctgcacttagcgaaggcctcagcggcctccatgtaagctttaatatgcttgaccttcacgactagcctccaattagaaccgcgatctcctcgtagtacccctcttcagggcacgcgaattccatgtagtactcgtcagtgtctgtcaaatagacaacgctaggcgggtaatagctccaagtcgggtctccgtgttcaatctccgctaccttcaagttgccatacacagtgcgaagagtctgtagagcctcgatcacatcgtcgatgcgcattacagtgggttcagtcggttcagtcatatctcctccttagttttctactttacaaacggcatcgccccggcgaaggaacacttgcactgatggctttccgctccacttgtcccacgcttcagctttaacactgacagtcttaggattgattgcaaccacctcgcctaccagcataaccattccagttccgcctaggcagaatgctactgcgtcgccgatctcgatatcccttcctgctacgtccttcatttgtactctccatctgcacccttgattaaaataacgaagtccgagggatcatcactgccgtaggcctttgcccgaaactcctgctcgtatttattcaccgcctccggatcacttttaacctcaagctcttggtagaggtcttccataaaccaacccaagtccgtggtcgcagccgaagccgagaggtgaccaagaagtcctaccagcatattgatctcgtcgctctccaactccaacttgtgaccgttacgttttactactttcatatttcctcctatcgcttctgtccgcttacgtcaaagtacgatttccattcttctccgaatagttctctacccttatcatcgtagactttatgagcctcttctgctgttttatagcaaccgaggtaaattctcttaccttcatacctgatccgggcaacgtacctgttgtttctaaaaaagataccgggatacccgtttgtattacgggtagacgcgggtttattctgctgctgctccgagtccgtcgcccaccggcaattagacttgcaatacccttttgtcgagtcctttctatcgagagtctttttctcgggtcgttctcccatgtcctcatagaacccctcgaatgtcttccacttaggatcgatggtaacatccttataatatttgtaactcttgtgctttgggttcgtacatctgtcgatcattgtcctccaagaattgtatgtcggagttccgtacattccatgggaggatagtagtttagactgcatgcacccgcaactcttattatctcctaccttgagtgctccagttctaattttcaaaattgccccgcagatgcattcgcatagccaaagaacctctcttgaattactcctcgctccagagtctccgactaccctgagatatgtgaatgtctgccctgtcaggtctttaactgccatcttacctccttacttgacgagtggctacgccgtaagctggcttgctcccctcgcccgtgttgtgtttcttctgcactcggctggcattgacggtgtaacgccctttgccatactcttcatctatccacgcttgggccttagctcgctgagacgtgtggacaaagatgtagtagccagatgcatccttgataaaccaagtggccgggggctggaagtccagacgtgaaaactcttcatagtcgatcacagtcaccttctgcttagccactgtatactgccccactaccgactcttttgcaatgattttatcaatcatctgagttgaaagatcagagttcttcgaggtcaatttctacctcctttcctagtccagtatctgcaaagaagctatcgagactcagagcgtggtattgagacactttgtaaccaccactcttcagaaggctgtgagcggcctcctctactttgtcctctgtcagtctccagtccgcacctaggagtacttcagctaactgctctacacttggagggttcccaatccacagacccattctactgtcaggctcgtaatcttcttcccatacaagttcccacactaggttactcattggtacacctccttcttacgaatagaatacataacccactcgtcttttcctgtcttcccgcacggaatgtctacttcacactctgcgtttacaatcaggcccgctacgatgaaatcaagaagctcctcgtctggttctggcaagcccgggtaggacgatacaaccctgcggatagtctccgctttggtattgcccagtaccccaagcatgtggagatcgaactctccactgtagtcgtcccagagttgtccaaatatcacccatacactattcatacctagtaatcctccttcagcttgttggtgtccattaggcagcctccttcttcttgtccagcaacttaaggcatcgtttgcaggtgatatgattgcggtagcgggagaagttcttctcctcgaagtcgccatcggtgccacagaagacgtcatacggttcttcactgtccgcttctgtgccgccgtcccactcgtcgtagtgaactgttcgcgtcgccattcacttcacctcgattccggcttgctggagggcttctttcacggcatcaagcactgcgttgtagctgccgattatcaggttgccgtagatgtttcttgtgggctccattttctccggcaactccaccctcagagccgcgcggctggcttgccatatccgccagtcatgatgtggtgtgtcgtggatgtattgatgcggcggatgctcatatcgatcaagggtgaagccatggtgcccatccttaatttgtgccgcgtagttacgcacgaaccacgcttcaaactcgtctctcatactccgcaatcctcctgaatctcttttagcagctcggaaggcataaccgacagcgccagttcctccagagcatggatgtaatcctcaacatatttccactcctttctgatcttctgaaggtacacgccttctttactgttgtcaatagcctgaccctccaactcctgcataagttcgaacatcttgtatatcctcctttggccgaaaaaatggccggcgactactgtcccggcctgatgatactactctgaaatttcttccattgcaaggcgtttcttttcaaagaagtcactgagcttatcttctagctcttcgccaccaatgtaaagctcttcccctgccttgacacgctctagctccttctcagtcaagaagtcactgtagacgtgatctacccatttatcgcaccacgctgagctaaacgctgcattcctcagactattcctgaaatcagcagatacaacgccaaaagaaggcgcgtggatcatgaaatatgtgaactggtcgatctcaacggagtcgcaggctagcgcgatggcagtcatggcagacgcacactcaccttcgagacgagcatgcactggagcttgacactccttgatcgctcggattatagcgttggcggtctctacctgtccaccgcatccgttaatggtgatgtacacttcatcattctgacctgcattttcaagggtccaaagctcctctgtgagttcttcgaggctcttgattacgtatggcagaaggatggagtaacgattgctaacactttgtgtacatgaaacaggcataatacctcctttacaaaaatgggcccgaaagggcccttattactgaatcactcctcgctttctttctggccagagcccagcattgcaaagaatggaaggaggattgtgctcagctctccgctgacagcttcaccaacttctgcaccagcctgagctacactcaggaattcttcagtgcgtacaaacttgtcaaccttgacgagggttttaaagtctactcgttccaagaacgcagtcccggctgcttccgctagaggttcgaggtttacgacttccatagcgcgatccagagcttcctgattgatctctaggccgttctgggctgcaacctgcatcagggtagacttcacagtctggattgcgtagtctttgaaaaactcacgttgtgctttgttaaacttcattcacttttctcctttgtagtacgacgacggcgggtttttggtttatcttccgattcagtctcttggacttcctctacaggagcttccttagctacttctgtagacttttcctcagtctgcttctctgcgccttctcggaccatcttgacagacttgagagcgaaattcatattggcgaaatgagggtcttcgagatcaatgcggaaaccttgatcgaaagcattttgcatgcccatcagaaggctgaaaacgtcccattcttgcacaatgacctcattgccgtcaagctctttttcaatctcagggctgacgccttcctgccggaacatctgcacttgacagagggtaccgtacacaggatagccttcaatcgaccgaacgacacggaaaccttctttcatgtgagcatgaatcgaacgaagccagacgatagggttgtattctacaatgttgataacttgcatattcttttactccttgcgggttagtgttttacaataataccacgtttctcaggaatgtcaacccattttgttctggtaaaggcttgacatagaggaaatctgtggtattatcaatattcagcgtgggagagatatgtctgaaagcactcaccggcccacgcctagcgcctatgaagaggaatccacaagggcaacctgaactcgaatgctgttaaagggtggagacgacgcgaaagcggaatgacagcaatccgatgcagcctacatgctgcccctcaccgaactcatctgcatgagtaagaggaattggatagagccaaggcacgtcttaggcagattaaattctgtatggcgagccttgggacgactctatccttccctagccgaatctatctgcatggggtgttctcctgatacacatacacaaatacccaccacagataatccatcaatcaacccataaggaatttctatgagatgtaagtgctgtgatagcgaactctcgtttgagactccagtcatcaataaacatactggtaaggaagacgatctatgctcctcttgccgtaggtttgctctcaatcctacactggatcatgagtattttggtggttggtatccaagcgaaggggttaccgctcctctgccgaccggggactgacattgtatatagagtgcgcgtactctgacaatacatataaataatagattacggtgcgaataattctttaagggcttgacaacaggagatttcgtgctataatcggagtatatggggcttacaaagcttcagaggatttaatatgactcaagaaagaaacaagggcggtcgccctacgaatgccgagctagaagcccggggtatcattcaaacagacctaaaagcaggactcagacttctaaagaagagctttgcagagaacattaggttcctacaagagcaatctgataatcctgaggtttctctacaaatgagaatcaagctcaagaaagagctttctgatatgttcgtcgcttactacaaagctgacattgcactcaaaaaagagcttgcaaaaggaacagaatcaggagataatgagaacactgaagaggacaagactcccggagtagttctcgcgttttgattaattgccgcttcgttcaatggtaggacgccagactttgaatctggagatgatggttcgatcccatcagtggctgccaaatgtagtaaaagaacattcacccgacaaggaatgtgtctcgctcagaggacagcgagtaataagtgtcctccagaattaagggtcggtgagcgtaattggcaacctactggattccaaatcctcgtattctctgttcgaatcggagtcggcccgccaaattagtgttgacaggagcaaagacctcttgtatagttacaccaactgctcgtatagtgtaatggacagcacaacggtcttctaagccgtaaggtctaggttcgaatcctagtatgagcgccaaattagatggacggaagctaaagtggataggcatctggcttttaaccagatttatagtgagttcgagtctcacccgttcaaccaattttagtgagtaaatcagataggttctgaggctccctgctaaggagtacgtctgctaacgcggatgtggatcgagaccactgctcactgccaaaaataagtgattttaagtgttgacaaactgaatttttcatgttttaatacacttatcagatgaagaaacaattagcgagtagccctgagtaggtcgggaactagtctagaaaactaggccactgcgatgagcggtgagggttcaactcctttactcgctgccaaattaaggccctgtggtggaattggtatacacatcagtcttagaaactgacgccgagaggattgagggttcaagtccctccggggccaccaaattaagaatctcttttgctatttggtaagggttcgagtcccttcccggctggatggtcggtctacggtggccaaatagtgagagagctaggggacatgacgaaggtagcgctgctttccgatctccccggcgctataaaagttatcatgaaggggttgacaaacaagaaattcatgataatataggtacatagagtaacaaacaatatggccagatagctcaattggtagagcacccgaccgataatcgggtggttgaaggttcaagtccttctctggccaccaaaatttataggcccattagctcagtctggactagagcaagcccctgtctagggcaaggtcgccggttcgaatccggcatgggtcgccaacaaggtcgttgtagagatagatggctactatcatccggctgtaacccggacgccataggctagaggttcaattccttccttcgaccaccaaatagcgagagcgttaagactggctggagctgtcactcggctcataaccgagcacaagtggttcgattccacctctcgctacaaaattgcactccgaggaaccctaagtggtgggttcagtgtcgctacctatctcggtaaggggaagcgcctaagctggcacgggtaattgagtagctgtgataagctactggcagccagtataaatcgtccggctcgggcccgttatagctcctagatttgaattagatgctgtaagccataggaggtgatccagtatctcccggaggggcccgggttaacaacctcatgaatttagcccgcgttggccgagaggtttaggcggcggattgcaaatccgtctcacatcggttcaaatccgatacgcggctccaaggtttatattgggatgtagctcagttggtagagcagggagctgttaactctcaggtcgcaggttcgagccctgccgtcccagccaatttacaaaagagactcttcgctttagaagcagagtcgaacgcccgttacgggccttattcatctcctcgtagctcagtctggttagagtgtctgatttggaatcagaaggtcgaaggttcaaatccttccggggtgaccaattaaagcgggtatagctcagttggtagagcgtctgccttccaagcagttcgtcgtcggttcgagtccgtctatccgctccaaacaatgcatttgaagctaactaggtagaagcgctgggttgaaattccagaggacttggatcgttaccaagcagatgcaccaaatagcgcagttatagattaaacggttaaatcgccagactttcaatctggtgttccgggttcgatccccggtaactgctccaatcaagtccaagccggaacattcctccgtatgtgctttcagccggcttggcattattcgtgtggagattgtgtagcccggatgctgcctttcggttgtgacccgattgttggggttcgagtccccgcctccaaccaatgtcgtgcaatggtatatcgcgttgacgcttttaggctctctggatcgtaagccagtaaagcgagaatagcgggctctcgcagcagagcgataggtggttcgattccacaacatgacactctttcctcctcgcctgtgctgaacggtttcctcctcctttcccgtctcacaggctctattccctgccctttaagcatttatggtgatgcaccggctttgtaacccggcgaattctgttcaagtcaggaatggggcaccaattcactatcaaagaacccgcaagctcccgatagggttcacactctataaggttgtagcatggaaaacactaaggttcctgataaaaaactcggaccaatcgcgctagcgcttaaagaggccagagagaatttcgatctcagccctcatgttattggtccaaaatctttcaaacagaaagagttcacagacagcgatgcaaagatcactgtattcggtggtgctgctggtgctggtaagtcttatctcggtgtaatggacttcatgaaatatatccatgatcctaacttccgaggtgtaatgactcgtcgtactactcctcagattaaaggcccgggcggtctgcttgaaaaagcaacagacctattcaagctcgttgaccctaaagtcaagtggaaagacaaagacggcaagtttgtgttctcttctggtgcagttattttccttcgacacttcgaacaagaatctgacaaagactccttccaaggttgggaggttagtaagttcctagtcgacgaaggtcagcagttcacagaaggcatggtgacataccttatctctcgtatgcgtaacccgaaatgctcggttgttccgcacatgaagattacatgtaaccctgattacaattcgttccttcgtaaatggattgaatggtggctagaccctgacacaggaatcccgatccctgagcgctccggcgtaactcgctggtttgtacgcaaaggcggtaagatgttctggggagacaccaaggaagagtgcattgcccttcatggtaatcccagtctagcgcctgacgatgaagatcaggtgaagcctatcagcttcaaattcatcgcggctaactgtttcgataacccaatcttgatgctcaacgaccctgagtatgtagctaaccttgaagcccttcctagggtagaacgtgaaaagctcctagacggtagctggcacgctagagaagagggagctggatacttcacaagggactggtgccaaatcgttccccacccgcctctacgggtgcttaaaagggtacgtgcatgggatatcagcggtagcatcgaatccgaaaccaacagaaaccccgactggacagccggcgtgctgatgagccgtacaaaagaaggcttgttcactgtcgaggatgttgtcagagagcgtaggttgttcggaggtgttttcgacctcattctagaaacagccaagcaagacggtcaagacgttgaaattcaaatcccatgtgacccgggggctgctggtaaagcttatgctgcccagctaattagagacctagcggatcatggattccacgccagaccgaagacaactaacaaatcgaaagttactcgattcgccccgttcgtatctgtagctgaaactaaatcagtgcaagtcgttgcgggagattggaacgaagattacttcgatgaacttgagcgattcgacggaagtaaggctatcaaagatgaccaagttgacgctacatcagatgcatttaatgctctatcccttggcagcttgattatccctgatttcctaccgcctgatatgactcaatccaacaaattcaaactaaattaataggaggcggcgatggccgagactgaaaaaacagcaccgggtatcccgcgacttcgcctaggcgagattggtagtacaggccttaaacaagtcaatggtactattctggaagaacgccgaccagaacttcggttccctagggcatgcagaacattccaaatgatggcggaagaccctaccatcaaatcagcactcgatctcttcgaaatgatgatgagcagggttgactgggaagttgatctaggagttgaccccgacgaggctatgaaggcccggggtaaattcctgaaagagtgcatgcatgacatggaacacagttggtactccttcatcaaagaggtcactagcttctacacctacggattctccgtacatgaaatggtgtttaagcgacgtgaaggataccctgtatcgaagtacaatgacaacaaattcggtattaaaaagttgccaatccgctctcagtctactatcaccaaatggttgtactctgaagacggtagaaacttcctagggtgtgagcaaagtcttgccaatgttgtcaatggcgaccgttacgtcaacctaggtaataaggacggaactgtagagattccagctaagaagatgcttcttttccgggtcgatgctaaacgtgacagtcctgaaggtaacagccctctccgtgcgtgctataacgcttggagatatcgagtagagattgaagagcaagagtccgttggcgtaacacgcgatatgaacggtatgcctacgctctatctgcctcctcgatatatgtccgaagatgctacagaagctgagagggcagtctacgaatactacaagcgagtaattcgtaacattcaaatgaatgaacaatctggacttatccttcctcaagcgtttgacccagaaagccgacaacctctgttcaaattcgaactgacctcttcgcagggcagtaagatgtatgatacagatgccatcattcgtcgctgggacaacaaaattctgcaagccttgtttgccgatatgctgaagatgggtcaggaccaagttggctcttactctctagctggtgccaagactaacatcatggctatggcgattgaatcgcggctccgcgaaatcaaagacgtactagataataaactcattcctacgctgttcgcactgaacggtgattatagtccagacttgccgaagctgcaatacggtgagctagatgaaatcgatcttgaagagttctcgaaagggattcagagaatcggttctgtcggtggtcttgaacgtgaccgtgaggtttacaacaagattcgcaaagctctcaagattaagcctcgaccagacgacgagcctgttgatgtggataatatcatgggtggtcagtctcaagcaggtaaagctggagtaggtaatggtgcatcaacatccgcagccggtagagacaacgccgctgcaaataacgcataaggagacagaatgctgactcttgaaagtgttattgaagctctcagcaatgctttcggggctcccgccaaggcggaagaagccccggctgtagaggtcacaaagtccctagacaatgaaaagaggatggctttgtttgtcgttcttgagccccaagaaggcgactccacgactgacctacacgcagacacctactccgaagaggaagtagagaaagcttgcatcaacttcaatactcattgcaacgtagctaatatcttccacaagattgaaacacaggaagctgagattgtccagtccttcatcgctccatccgcattcacaactgacgacggaagagagatcaagaaaggtacatggctccagtggtggcacttccctgaaggctctgaagtagccgatgcactatgggaaggcgttaaatctggtgaattcacaggcgtctctatcggtgccagagctacagtcgaggatatcgaatgaccgtaaaagcaaaacgtaaactgaccgatatcaagtttgaacacgaaggtgctcatgtcgctctggtcagtaagctccaaggtggtgcagccaacgggcacactactctaatcacaaaagctaccaatggcgtaactgaagagcttatcgataaagctgctgaagttacagtcacaatgcagttccctgagttccttcgtaagttcttcgggatgtattatgaagatgccgaagttctctctgttgccatgggatatggcagaacggagtatccagaactagatcacaaagactggatcgaccagcgggtcgagtctatgtccattcttaagtcggtttataaatcggctgacctgaatcaagctctctccgagcttacccctgagcagaccctttcccttaaacaggatcaggaactgcttgaaaaggctctggaggtagtctccgagcaatccaatgaaaatccatccaaggagattaccaacatggaaactatcctgaaatcggcccacctagaagctctagctgacgctattgcagttgaaaaagctgctggtgtcgctgctgttgcagaagttcagaagcaactagacgccgctaatgtagagcttacagctcttcgtgaaattgtcaaggctgctgaggcagagaaaaccgctgctatcgctaaagcccgtaaagagcaactggctgaagtcctcccggctgaccaagtagaagatactttcaagtctctggaagttctggacgatcaagcttttgcacaaacagtaggaacgctccgcattcttaaagctgctgctgaccaaaatgacatgcttgtcgagaaaggtgtatcgggcgctggggaagaagacgactctgttgtcgccggtgttgccgctatcctgaaagctcgccacggctccaagtaatatctagccaatctagaggaattccaaatggctcaaaacattatcgcaaaagatcatcagcgtcttagcaactggctgaaagaagaacaaatgggccaccgtggcctgttctacactcgcgaaactctgcctgtcgctgacattgatgttaaaacaactggttctgtcctagacagcactggcaagctggtaactaaggctactatcgccgacgctacctacatcctaattaccgacctgcacgactatgccaacgctcagatgagccacgctgtcgtccttgctcgcggttttgccaagatcggctccaaggctgttatcttcggtgctgacgttgacgacgctgataaagctaccgtctttgaagctttcaaagccaagaacatcttcgccgttgaccagatcgaaggcgcattcgagaacgtcaccttcgcgtaagcgagggtcgttccagtaaataaacactaggagtaactttaaaatggctaacacccgttcctacctaaacgatggtcagttctacattgccgaccagactgaaaacctgcttatcatcccgaacacttggaccctcgtcgagaacatgggcgtcttcacaagtgaaggtgtgactcagaacactgtccagttcgaagagatcgaaactcgctacggtctggttaaggatgccatccgtggaactcgtcaccaagttgctagcgaccaacgtcgtcaactgcgtgccttcgcgattccgcacttcaaccaagacgactacatcactccagaagacattcaaggcaagcgcgctttcggtgctgaccgcgaagaaactctgaacgaggttcgtgctcgtaagctggaaaccatccgtcgcaactgggctaacaccgctgaagttgcttccgttagcgctatcgtaacaggtaagagctacgccccagccggaaccatcgagtacgactggtacgacctgatgggtaaaactcgtaaggttgtcggcttcgacctgaccaaccctaccgctgacgttatgggcaagaccgaagaaatcttcgtccatatgcaagacaacagccaagacggtctgatccgtggtgacttcgttgccctgtgctctcctgagttcttcactgccctgattaaccatccgagcatcaaagagttctacaaagcttaccaagctagtcctcaatactggcgtgaacgtctaaccgctcgcggtctggaccttcgcttccgtgagttctacttcggaaacattcacttcatcgaataccgtggcgttgacccgtacggcaaccgtctgatcccggctggcgatgcttacttcatcccaaccgacagcggtgacctgttcgctcgttacttcggcccgggcagcactttcgatgacctaggaactctgggtaaagaactgtacgctaccgagcgtatggctgaagaccgtcgttcgatcctgatcgaaaccgagtccaacttcatccacgttctgcgtcgtccacagatgatcgttcgcggcactgtgaatgcgtaaagacttcagggaggcttcggcctccctttcgtcgtaggagggtaccaaaaatggcttacactggtgatccagcaaacaaccctatcgaccgtctacgagagattgtaggggacgtgtgggagcctccgatgctttccgacgaaacctatcaatgggtgttggacaagaacgaaggcaacgaaagacgagccgcacttgaacttatgcgtatgatgctcttccgcctgacaaggggaatgagagaacgcacaggtgatatcgaagtatatggtgctgagtatttcaacaactacttgaaagctcttcagctcattctcaaagacccgaatattacaatttctttggccgtgccatatgctggcggtatctccaaatcggatatgctggctaatgacctagaccccgacaacgtaacacgggaattctacatcggttttgcaagacgggagaagctttacaaccagtgcaaccccggtcctcaagaccttagcatggggtgtgattatcttggcaagcttcagttttaaaacagatcgccgtcgcctcacatccttgattaagagggtggaggctctagacggaacaacggtagaagttggtttcttccccgaggaccgatatggttctgaaaatggaaacctaccagttgcacaagttgcagcttacaacgaattcggtactactcgcaacccaacccggccattcatggctccaacctttgaagaattcacatctcaattccactacgcaagactaatgaagtccacgttcgagaacgtcctacgcgatggaaggcagacgaatactcttctgaagaaattgggtaaaatggttgcagagcagatgcaagttaacattgacgactacccgggctctaacagtcccgcatgggcagcttacaaagggttcaacgatccgttgttccatactggcaagatgcttgagtctgtcaagttccaaatccatcggaggcaataatgctctatcctaccttctccatgaccaatttcgtcaagttagacttgattagaagaggacagcccggagacgacggttttggaagacctactcctccagttgagacagtagtaacaatcacagctaacgttcaacctatcgagaaatcgacagacactcgtatccttccagaagccgacagaagtaaagcttgcttcaaggtgtattccagaggcgaagagattcgacagctaaaggaaggcccgggagggtggagtgctgataggtttatctgggaaggtgagctgtacgaggtgatgaaagtcatcaactattcgatgggaatcctaaaccattacaaagcgatttgtatgagagtagagaggaatagtacagcatgatccatacagagctagaaaactctctctatcttatgataaaagagttgttccctgattggcgtgtcatccaagcatacacaaataatcaggaaccgcaaaccccttatctggctatcgatattaagaagctagatgaactgggaagggaaaatgtctccaacatgagcgatcccattagtccttcgcatggaactattcaagttcaacaggacttcgcagccaaagtcgtattcgaactgattggcaagtatggagagacagcaagtgtctctgacatggcaatggcgattactcgggcaatgcgtactccagcaggacacgccgcccaaagaaagtttaatctatcccttttcaaactccctagcacaagacgagttcctatgctaagagaaacagatatgtacatgttctatcaagttacatgtgaatttggattctctgtgatagaaaccacaactcaagagtttgctgctggggctgatattcacggcgtttattacgacgctggtcgcccgggtcacattattgagtcccacatcgacataaacttcgaacactaataggagacaggaatgactgttcttactgatgtaattgacattcagatcagccgtgagactgctgctgtcgcacagacaaacttcaacgttcctctgttcatcgcttctcacacaaacttctcggaacgtgccagagtctacaacagcctgaaaggtgtcgctgaagacttcggagaatccgatccaacatatcttgccgctgttcgctacttcggtcaagctctcaagccacgcagcctagttatcggtcgtagacaagttccttctgctaccgtatctgtcagtgttgttcaggaaggccagagctacgttctgaccgtcaacggactaccagtcagctacgtcagccagcaagacgacactgctactctgattgccacaggcctaaaggcagcttatgacgtaactccggtagccggcgtaaccgtcacagacaacgaagacggaactctaaccgtcgcttctaacgaagactggagcctgaaggtttcttctaacctgactatggctgctgctccctctactgaaggttggccggctgctatcacagcagttcaaggagaaaacgacgaatggtatgctctgagcattgacagccacgccgatgatgatatcatggcagtagctactcatatcgagggcaccaagaaagtgtttatcggagccactgctcaggctaacaccaagacttccgcagagaatgacattgcttctcgtctggttgctgccgggttccaacgtacggctctaatttaccatccaaacgctgacgctcaattccctgagtgtgcttgggtagggtaccaactgcaagagcaaccgggtagcaacacatggacccataaagctctggccgctgtagacgcctaccgtctgactccaaccgagtctaccaacctgaagaacaagaaagttaccacgttcgagcgtgttggtggtgtcaaccgtacattcggtggggctatggccggtggtgaatggattgacgtaatgatcttcgtagattggctggaagcccgcatgaccgagcgtctgtggttccgcatggccaactccaagaaaatcccttacgacgctgttggtgcaacaattctggaatcggaaatcagagcccagcttaacgaaggaattcgtgttggtggtctggctgaagctccagctcctaaagtcttcgtacctgatgttctatccatgtctccgaacatgagagcacagcgtatcttcgaaggcatcgagtttgaagcccgtctagcaggtgccattcacttcgtacacattcgtggaactgtgaccgtctaaagacggtccttcccataaggagactactaaatggctgttcaacgtctagctacattctctccagccgatgttaccattgttatcactcaccctgcaactggtgagagcatggttctcggcggattcagcgaagacagtatcgttaacattgaaagaaacgctgacacttacgtgatgtataccggagccgacaacacatcgactcgcgtctacaacgcctctaagtctgctaccctcactgttagccttcaacaaacttcgccttcgaacgacttcctgactgctctttacaactacgacgacgcccgtcgttcgtctgagggattgttcacaatccacgttaaagacaactctggtcgttccgactacttcagtgatgacgcctatgtcggtgttgttccgggttctaacttctcgaacagcatgcagacacgcgattgggttattcatgcacacaacctgcaaactctaatcggcggtaacgccaagctgagcccgggtgatgcggatactcttcgtaacctaggtgtcacactagaccagcgctggctgtaatatagcgcttatgccacatcgacggggagctgccttaacgggtggctccctttgttgtttctggaggatagaaattgattaccacctactcgccgcgtgacgtggttgtaactctcgctggtatccattccgtgacagggtacgcagagggagagtttatcagaattgtaaaagatattaagcctttcatcaagcacggatcgatggacggagaaatcgcccgggtctacaacaaggaccaaggctggcgagtagagttgacaatcatgcagtcctcgccgactaacgacattctctccatgctatataacgtggacattgcaacccgaatgggaaaattcccactgatgattaaggacacgaagggttctacaagcttcctagctctgacagcatgggtggaagacctacctagggtatctttctctggacaactggagacccgcacttggattctagggtgctctgaggtcgccatgaacattggcggaaacgtcgatcaaagtttggtcgagcaagctatcctgctgggaagctctcttctgccagcccttacgcaattcggaggcttctaatggctaacacggtattgacatatagcccatctgatgttaaaattgtcctttgtgggtatgctctcactggtgtagtttctttcgaaatgtcttggctttcgagaccctacacaatggttcgaggaatcagagggcaccacacccgggtcttcaatagagacctttctgcgcagattagaatcgaggttcttcagacttcggtgtctaatgatgcattcttctcgctagtagagcaagaccgaagaacacaatccgcccgaatcaccttgtctgtcaaggatacccacggtagcaccatgatgagcacagacaacgcttatgtcaatggctaccctagcataacattcaccgatggaatcgagaacagggtctggactattgatgttctggactggaccgatggcacggtaggcggaaaccagcaagtcggcttcgacgtgtttggaactgttcaaggcgctcttagctacctcagataaataaggagtatttatgttcggaaaccaacgtactgtcatccacaatgggacagaatacactatcaaccttctgccagcaactcgcggtatcagcgtactgaagcagctaaccagcttgctgggtccatcccttgccaagtatcaagctgaccacgacttctctggagccatgaaagaactgttcgataacatcgacaaggttcctgttgagaatttgatccagaatctgatgctgacagttttcaaaggttcgatggcaatcaatttcgacaccgaattcgctggcaagtatgacctgctgtacgcactcacaaaagacgtgatcgagttcaacttcggctcggttttttctctaatcggtttcgcagaggcaccgacggtataaagaccggggatgggcagtccgagacttcagtcactactgatcgagttcagagtgatcggagggttagggaggcccaccagaagttctcgcagcattgggagatttatgtggctatcactcaccctctcaagctaacgacgtatggggaactgagtacagtcctcactacagaagatttgtacaacatccttgaggttatagacgttcacgatactatcactcaagtggcaaaagaacacgcagaggctgataagaaatgattacagaaaggattgcccagctaactggggaacttaaatttacagtcgattcccggcctctcactgcttttgacaagaagctcgctggggtcgaagcccggctaagagaattctccaagctgacgaacaagcggtttggagttaagctaactctagatacaaaaactctgagagaggagcttgccaaggcagccactcaaagggtagtcttgaagaacatcgcggtagatgctgccgctgttcgtcttatctctgagaagcttcaagaaagactgaatgcaacgccgatcaggttgaagtctgttaggctagaccttagcggtatccgagatcagaaaaacttcgtaaagacggctctcggccagaccaaggtcgatctaccggttgaactgggcttggctcaggctagccgtacgctgtatgaatggaagaagcgcacagagagtcgttttaaaattcatctgaatgcagacattagccgctctaaattgctccagaatgcacgaaacacactaagggatgtgcagggtaggctaaacggtcttgctgtcgctacgcctcaaattaggctgtctgtagaccgtgcccatcttcgtagagagattcaagatgttcttgagcaaatcagacgcgaagtgagaatccgcattgacctagagtcttccatccgaggaggtggtgcaggtggatcgagaggtacttccggccatatccgtcaaggtatgggaatggggattggtagcgagctagccgggtggggacgcgggtttattcccggccttggtggtgcgttcgctattatgcagcttaaccgtgcaaaccaagaacttcaaggtcagcgcctagcgatgcaagctgtcggaggcggagtacaaggtggccaagaactgcaagctaccctccgtgatatctctcaacgcctaggtctcgacgacagagcccttggtagctcctatgttaagatgatggctgctggacaggcatcggatttcagcaaggaacaagttgacagcatcttccagtctatggctgaatatggtcgagtgatgggccttgacggcgaagcgatgaaaggctctttccgagcggttgagcagatgatgggtaaagggcagattatgtccgaagaattgaaaggtcagttggccgaaagattccccgctgctgtagctctgatggccaagtctcaagacatgactatcgcggaactgatgaaaacgatggaagacgggaagcttaaaagtgatgccctgattccatttgccagaactctcgctgaagaagcccgtaaaggtggcgctttggatgctgctatgcaaggcaccgcagctcagcaaggtcgattccagttcggatggaaccgcactatcgaagcattcgccgctggcggattcgatagaggtatgagtgacttctttaagattgctgcccaaggcatgaaagaagcgcttcctctggtaactgcacttggtggggggttcgaagctcttatgaggcctgtcaacgctctggtcggtattggaggggagcttggttcccagtgggagaacattgccaagcagttcaacatgaccggcacagggctgactcttaccacggctcaaaccctagccttgctgacccctatgggcaggttgatctcttctattagctggggtgcgttggcactggaagacttcattgtcttcttggaaggcggtgattcggtgttcggggacttcttgaacaacaacgtacaagctgccgagacattcgaaaagctagccagtgaatccagtgaactgaagaacaatctcgacggtatcttctctgttgtcccggggctagctgaagcgctcaaaggtctagagttcaatgaaatgctggtcagcacgatgagagaacttgctgccatcatggagttcttcaacagtgttgtagagagattcgcaatagccggcaagtacagggacgctaagattgctgaagccggaggagacagaagtactataatgtcgaacatcgacacgatgtacgctatgttcaatccggaagatgcaaaagacaaggccaccttcatcggtgacaggctagtagctcagaacattgacgcgatccagacagagactcatacccgtgcaacccagtccttgactccagaccagtttgggtatatgatgcaacgtggtcaagttagaaacgaaatggagggtgccctcaagaagagtgccattgacattagtttcaacctcaatgtttctggtatcgatgctcagggtaacgtcatgacaactgaagcgcaagagcgagtacgagagatcgttagtaacgttcttgaggaagaaatctccagagcttcggcaagttataaggaatcccaatgacaattgctatcaaaagagagaacggagacctaatctggttcgacgctgttacagagttcggaagacagtaccgtggctctgtgagttccaacccaatcgaaacgggaggaaaaatcacagaccacattactacagaaaacccagtcttcactcttacagccgtcgtatcagacgcagacttcaacttgaacaggcccgttatcaacgacaacgaggcccagacatacaagatcaacaacaaagagttcgtgaatacgcagccggtcagtgtgccggctgttatcacaacttctagatttgatccgagccgaattttcccggaagttattactcagtttattcctcctgagattccgtctgctactgtcctccctcaaaagggtgataaagtcgcttacgatattgagcgccaactgatcgacatgcagcgtaacgctgaggtcttcagcttgctggactttagagacggtatcatctgggatcaaattgagaggtgcatctttactgacctgtcgttcagcgagaatgctgaaacgggacagagtattcagcctagaatgactatcgaggccgtgacattcacagacactcgctacattgaagttagggtgaacaagggaagaaagacagccaagaaggaaaagagagacaccaaagatggtgatacaggggctagcaacgctactggacaagactctcctacattcaagcgtagccagatgaaagaggctcaaattagaactcaagttgcgaggtgattaatgagcacgacttacatcgacacacttcctttgtaccaagataggaagtatagatacgcggtagctctggagggcatttcccgtgtcctccaattttactggaatagccgctctcggcagtggcacatggatatattcgacgaggaacttaaccctatcctgacaggactggcggttgttccacaatacccgataattgcagattacgcgatgcagcacatcgggtttaatgggtacttcttgctcatgcctgtcaacctagaacaggtgcagtacaagcacgatgcaagcgacattgtacctcagttttttgaacttctgtatgttaatgttgatttggaggaagatgcagagtgagacaatacgacagagtatataaattgacgctcggtaatactgagtctggtcagggagtagagattacaaaccttcatcctgatgggagtgttaacagagaaggacttcagttcaggtttgatatctctaaaagctccgataacaaaaagagcggcaactcggctactgttgagatatacaatctgtcgattgcaactctaaaccttcttgaaaccgaataccttacttgcagactagaagtggggtataaagaagctggaacttccgttgttctagatggtaatgttgtcgaaacatccacaagaaagagtggaaacgactacgtgactcagcttattcttggtgagggttacactgctctaactgagactaagctgaagggcacagtatctccgggcaaaactgtaaaggatgttatcgaagagattcgtcttcaaatgccgggagtggacagaggagcttatacaggcctcaattgcaataacccgatcatgtacggctatcaactccgtggtctggccaaagacgctctaaacagcgtgtgtgaagccaacaatattgaatggaacatcagtggaaacgttctaaacgtcacagacgttaacggaccaacaacgaagagtgttcaaatggctcctctcgtaaacagagagaccggtctgatcgatatcccattctacgccagtgccagcggaacggcacagaagaaagataagcggagacggagaggcgttcaattcaaatgccttctcaatcctgagctaactcccggggttcttgtccgggtagagtcggatagattgtcaggaactttcagaatcaacaacgtccgaatctcgggcggatacagagacaacgaatggtacactgaatgctggtgttccgatcttaaccaagaggatattgaccaatgaggagaacaggcctacaagagcttctgaacctgcactcgtccacagagggttcgaagcagtacactgccataccttgtgtggtattgcgcgttctggacgattttagacgcctttctgtcgatgttagaccagtggtcaacgacctgtacaaagacggcacatcggaagagcaaccagagattctatctgtccctgtcattatgccgggaacagctaacacacttatcagcttcccattgaatgttggggatacggtgttgtgtgtattctctcaaagaactatggacgtgtttaaaggttccgccaccggacagccacacactccaaacgatcttcgtaagttcaacatggcagacgccattgccattcccgggctgttcaccttccctagatcgatgaacgaccctgcaagacatagttggccgcacgacaccaaagacctcactattgcccacaacctgatgactggacaagaggccgaggttaggatcaaagctaatggagacattctaatcaacagccgtaagactataagcattaatgcccaaaatgtcaacgtaaagtgcgcttccctcactgttgatgcagcccatacaacatggaacgggaacattgcacatacaggtaactacgtgcagactggtggaacctctacattcaacggtattccattccatacccacaaacacggtggtgttatgccgggcggtggtgttactgctgtcccacaagcttaaaggagatcatatggacttgtttgtcaaccccgacacacatgacttggtttttataaatggtgaagctccagtcactcaacgaatggttgatattgtcgctcagcgactaaagatcaaactgtacacattcttaggtgagtggttcttggatgatcggatcggcatcccctacttcgagaggattcttggtaaatctaggagccttcccgctgttgacgcgatattccaatctgagattatgagagaccccggcgtccttgagattacatcttggcagtcagggatcgaccctcacacccgtgaatactccatggagttcacagtcagaaccacagataatacagaatcccttcccatcactttcagaatgataggagtttaatatggctggaattacagcagaaggtctaacgattaaagacttggaccaaatcctgacagactacagaaacgtagcctctcaggtcttcgccgacctagtttcaactggagacgaagttgacacgtctggtaactctgctctaggccgtctgatcggcgtagttgctccatcggacgaagctatctgggaagttatccagatggtgtataactccttcaacccggcagccgcaactggcgtggctctggataacctagtatccttctcggcaattagccggcatgctgcacgtccgacccgggctcaggttgttctagagggcaacatcgacaccgttattaactcgcctcccgcgaagatgatttccagcagtacaggccgagtgttccacctactacaaggcgtgatcctcactcctaaagcttgctctggtgttggaatcttccctcagacagtaggcaacgacctgacgtacgagcttaagatgtacgttgatgacattaacacaacgtctatcaagtacacaagtcctgccactggcacagtaacatccgagtccatcctagcaggactggccgccgacgtagctacaaatcacggaaataccttgacaagctacgaacagaatggtatacttttcatagtacctattgacccatttaacaccaagactttcgaagaagcctccaacctgagtattcagaaggttagaaagcttggtatcgctgttgacgacgttattggccctgtgcctcagcaagctctagctatcgatacgatctccattcctattgccggatgggacagcgttatcaaccctgttccagctatcactggccgtctgcgtgagaccgacgatgagcttcgcgagagattccgaaactctaaattcgtacaagccaccaacattctggagtccctaatcgacgggctgatgaacgtagaaggagtcgaggatgttaggattatcgaaaacgatacagacaacccagacccagttcatggagtcccgggtcactcgttccttccaatcgttcttggcggtattcctacagaggttgcacagtctatttggctgaacaagccattcgggattggctctgttggagatacagaggttcaggtggtagacagtctgggatatacccatagagtcaactaccagcgccctgtcgaggttccaatcgagatcaagatcagtgtaacaaacacaggatcgatgccagagaacattgaagatatcctacggccaaggattgtagcgtacgggaccgagaattacaagatcggagacgatgtaatttattctcgattctatgctccaatcatggaaatcccgggcttccaagtgaacagcctgacgattgccaagaaaggacaaactcaaggcatggcgaacattgaaatcgggttcaaagaagtggctacattcgccgcagcagatatcaccgtaactacggtgtaatgatagaaggagaattccatggctgtcaaccaatttgacagagaagattatctggaggtggcccgggaacgggtcactgaacagtttaaagagaagccgatctttgatcgcttcctgcaagtgctattgtctggtaagtttgatatccagaatgcactggaagacctccagactctccggtctctggacacagccaccgggaagcaactggacattatcggagacattgtagggcgaccacgcggtctagtgtaccaagatattttcaactattttggattcgctggaacggagcgtgcaggttctttcggaagcctgtcggaccctacggtcggtgctccatggtactctgtcggtgctccaactggtaacgccagagagccgagcgacgaagagtatcggatgatcctgaaagcaaagatcatcaagaacagaacaaactcaaccccagagcaagttatcgaagcttataaatttgtattcggggttcctgaagtattcctagaggagtacgctcccgctgctgtccgtatcggcatcggtaagattctaacgaacgtagagcgtagtcttctattcgacctaggtggtgcaggtgcattgcttcctaagactatcggggttaactacacatacactgagttccaagctggccgggtatttgctacagaaggcttccccggaggacaaggcgttggagacctaaacgatcccactgttggtggaattctgaccaacctagtgacataaggagttataaatggctgattacagtcaactacctattgaaaatatttggtccacaggcggggatatggtagccccgacccctgcgcagcagcaaggcggatggggtattcagtcggttcctcgccaatggtggaactggaagtggaaccttcacgatactaacctagcgtatttgctacagaagggcatcccagagtggactagtacacaagagtacattgctaacaaatcgttctgcactagaggtggatttgtttacaaggctgttcgtacgcatacaggaagcgaccctgcacaagttagtgccaactgggttcgagcttttgcagattacaccacagctagttcagcactagggggcctgactccaagggaaggaggtattcctttcttcattagcgcaactggtgcaggcgtgtttgactccactgcttacggtcgtggcatgctgaacgtagctaacgcagccggggttagaaactacatctcggctcaagagagttccgttgttctgtctaacctagctgctgtaactcgggctgctaacgcggttccatatttcaacaccgacacttctatgtcgacgtttaatattacagcatacggaagaggactagtcaatgcggctgatgcagctaacgcaagaaccttcctaggccttgctaactctgctattatcacagcagacccagctaacagagcccacactatcgtttatcgagacgcagcaggtaacttcaacgcaggtgtgattacggctacgctttctggtaacgcgactacagctaacaaacttagaactcccgtcacaattaacggcgttgcgtttgacgggagttcggatattgttctccccggtctcgacacaagctacgctggaacagtagcgaggctccacgttaatggtgccaacatgactggaacggacaaaactacgcagattgctctaagaaacaaatcgaacagcgattggatcagtcttgcagtagtcgatgacaacatccttcagtttgctttcagaagtgccacaaacccaatcgtgcagatcggtagtgaagttgtcctgcacactggtaaccaattctcccttggacctactctgagcgatgcacgcagccgactaggccttgacaggctgtctcaagggtctcctgatacagttgtgttctccggtgttctgaataacggagcatacctcactgttcagccgtctagcatcggaggtttcgacggtgctgccaataactggatgttccgttttgatgcgaatggtaacatgactcatggaactgttccagttgcgagagtcactggtcttgccaactctgctacaattcctgccgtaaccactgctcaggctaactctcttgtccagagagacggaaatggaagtttcagcgctattggaattaacgcctacgggcctattatcggatacggctccaatatctacagccgagcttctgcgtctggaggtaatgcccatattggattccaaagagcagacggctccgagattgggctaatctggggtgttccttctagcggggctatgagtttccgtacatcgggtgggaccacgggtatgaccctgacaggtcaagatttgcttgtcgcagggcgcgttaacgctaccactttgaacgcctctggaaacgtcaacgctacagggaacgttaacgctggttctgctactctgaacacagcaggtaacatcacaggtcctgcttacggagcttatggttcgattaccaactgggtggattctgtttacgcgaagaagggagagattcctaacgatatcgctagagctggggcagcttgggacgcagttgggcagtatatcctagctggggatcaatctggagggtctggtggaccggggacaactagagctggaagccagttgaagccttattcgaccatcagcttcacagcaggggcactaccggcagcgggcacctatagatgtatgggagcgtttgcaggtggtggtaaccagattaccctgtggcagagaatttcttaatagagggcttcggccctccttttagaggagattatagtggaattcagaaatgttgtaaaatacaaaatggggttcgaatgcgaggtaaatcatcctcagtggggatggattccgttctacgcttgtgattacgacgatagagccaaactggtatatgacgccatcgcccgtgctgtcgataacggagaaatccccgaaccaaaggacgttacagatagagacctcgttgtagatgcacgtctgtggagagataatgagctaacccgggctgatcgtcaagtagaaattgctatcgacgatgaagacgaagtaaaagagaaggcttggcgtaagtaccgctctgcactacgtaagtggcctgagcataaaaacttcccagccgagaagagtaaaccaaaagctccgaaggagtgaggtaagataatatgccaaacattatgaagcctacgggaatcaacgctatctggtctgaaaatggccagaaggttgacccgggtgctgtgaaagtagggctaggctgggttacggaacttcctccgtaccagactgcaaacttcattgaatataaacaagacctgtttaacgctcacgtcaaccaacatggtatccctgaatgggatagcgtgacagagtatcagggtaacctgagctacactcaaggcgctaacgggatcatctataagtgccttagaacccattccgacaagattccaactgaccctctgaacattacagccggatattggcgagtggcgtttgaggatgcgggagaggcagctaaggttcaagccaaccttgatcggcatgtaacaaactacaacaccctctctgggattggcaacgtagttattgcaagacaaaacctaagtgtgtatagtaaagctgaaggcgacgcccggtacgctatgaagcacgggaacggctctaatgttttcagcgtcgccactgccacacagccaactcacgcgatcccgctgagccagctatcgactctcgttcctcctgcgaccgagactgtagccggggttatggcagttgctacgactatcgagacagaagctggagccaatgataccaaggctgtgagtccgctcaaggccgcacaggtgtatctgaagaagaaagacaacctttccggtctgtctaacgtcactgccgcaagagctaatctaggactgtcggatacagcgactatgccttcttctacattcctgaaggcaggtagcaatctggcagatgtgcctaacaaggcgctggcaagatcgaatcttggaattacaagtagtgctacccagccggaaacctatttcttgaggagcgctcagaacctagcagatgtacctaacaaggcacaagctagagtcaacctaggactcactgggatggctacaacagaccctgcggcggttatgatgaaggcagacaaccttgctggattggctaacactgctaccgctcggtccaacctagggctaggcacagcttctactagaaatacaggagacttcctgtcgtctggggataacctgtccgacctcacgaatgtccaagcagctagaaacaacctagggttgaagggagcggctacgctcgatgtatggggtcttcctgcgaatacaactgccatggacttccagtccagtcagtcggatatttccagaggatgggctcgactaccaaacggccttctgctacaatggggaactggtcccggtctgtctgatgacacaaggacgaatattcaactccctgttcctgcccgcatcttgaacgtgcaagtgactgtaatggggacgtttaacaactccatcggcccgggcgctttcatgacggatatgtggagtaacacggggttcagagttagctgcaactggggtaactggtcttatccgttcaactggtttgctatcacttcaaccctgtaattcaggagtattaaaaatggctctaactgagcaagacttccaatcggctgccgatgatctcggagtcgatgttgccagtgtaaaggccgtcactaaagtagagagtcgtgggagcggctttctactttctggcgtccctaagattctattcgaaaggcactggatgttcaagcttctcaaaaggaagctaggtcgtgaccctgaaataaacgacgtttgcaaccctaaagctggaggatacctcggcggacaagcggagcacgaacgtctagataaagcagtcaaaatggatagagactgcgcacttcaaagtgcctcttggggcctattccagattatgggattccattgggaggcactaggttatgcgagtgttcaggcatttgtcaatgcccagtacgccagcgaaggatcgcaactaaacacttttgtacgcttcatcaagatcaatcctgcaatccacaaagctctgaaatccaagaactgggcggaatttgcccggaggtataacgggcctgattacaagaaaaataattacgatgttaagctagcagaagcctacaaatccttcaagtaaatctaggaaggttcctaatgaagaagctattgaaaagctggaagttctgggctgctgtaggctctgcaacttttatggctctggaggccatggttcatctttgggagcctatccttcctcccggcgtattcgccgcagtggccacactggtagctgtcggtgtaagaatttcggcagtgttcgtaactgctggtaaagtggaggaagcgatttcggaaaccatagaagatggctcaatagaaaaatgatactaactaaactcaaaaactacgccctcgtagtagctgccgcaatggcagcagggtttggatatctgtcgttctctttgtacggcgacttagctgttgcgaagaatgatatccaatctcttcaagctgcgtctcgacagatggaagagcagttccagaaagagcgagcagggtgtgagatcaccactgggagactagaggcacatatagcccaaatgaagagccgacaggagcttctacaaggccacctgtgtgagcttgagtctctacccaacccaaccccaagggagacccaagaaaatgccacagagacgatctctgagccttctactggggatagtctggaccctgctcttacaagcttgctcgacagagctttctgttccgcagtaccaaacgatccttattgtgcccccggcaagcctgaccgatgaggttaaggtataccgagtggagcaagatacagttaaggggctcgctagagcttacattctaaatactaacagtgctgccatgtgcaatagtcaactacagacaataaagctatgggcagaagagcagagggctctatatggaaagtaaagacggcaaagaaggcctaatcaaggtagctacacagggagttatctctctgctaattgctatcctaatggcttggtctggattcctaagttccagtctttctaagcaggaagaacgtatctttgcgatgcaaagagatatggtatccgaggcaaaacttaacgcactagagtcgagattcaatagccgacttgaaagtgaaattagtaacgtaagaagagaacaacaagaaaccaaccggtatttgattttgattatgaatgccgtcaagggtcgggatacagaaactcaataactataacccgttaacccacactgggagacaatataatgacaaggaaacaagactggccgctagtttcagcagtcggggctttgtttatctccctccttgtctgtatggctattctggctttcacagcgatgactcccgaggctcggtttgactctgtacgccagacctacgagattcgaattagcgaatctgagcggcggtatgaactcaaactgaacagactacaggatcagataaactcggcctcgtacacacaggatcggcaatcccgtttgcaatatgaagaactcgactcgcttaaaaggaagattagcgaacttgagcggagaataaaagaaaaacaagaataattaagccccgggagcgaaagcttaccggggctctttgttatgggttttcagcgaacaacttgataaacttcatcgaacaggtcatcaagcttctggataaccttcttagccagcttcttgcgaactttgttagcctctgggccggaatggagtagcttaatatcggacgcgttgccccagtccatcgccccgttgtcgaacagcactttaacattcagatgcatcgagccctcgtcaatatcgacaactacgccggtcatccgagcgttggtcttttcgaaggtcggcctcggaatgtctatgtccagactgccaaccataacaacctgccctttcttaacgtcaaataattccatttaaaacctccttaatctaacttcattagtgtgttgaactgatgcctcagagacttaaaagcctgtggcccatcgtcttccgctccttcatgaatgtggtgagcgataaggtgtatcagtcctctgtctcccagcaaaatagagctaggaatctcttttatccaagctacaaagcagcagaagtgtaatacctctggcatagaagccttgaagctggaatcgtccagcttcgacaggcggttatacgtggctttgagatcgggataactcaactcatacgttgcatagtcgtcgatgtgctcatcaccactcaccatatattgcaagctcattctacaccttcttgccgccttctgcaaggcgagcttcccgcttgtggtctgcacgggtcatgttgtactcgatcttctcgatcatagctcctgcaacatccagaccccgtacattcgcatagtccatgatacgaatgatagcgtctgccagttccacctcttccatcttccgctctggcaagtgatcgtccatcaagtccttacggacgccttcagcagcttccgcaatttcagtggtaacgagcatcagcatgtgcagagcatcacgtttaatcggctcgcctgtgaccagatcggtgttccacttgcggttaacaacctcaagaccagtcatcattttgttaaaaccgctaacaaactcgaagacggactctcgttcgaatagttcaccgaacgttggctcttgatgttcggcaattgcagtgtggaaaggccactccatccaagcgtcatagtactttttgataagctcttgttcatcaatgtacgagaagacgccctgctcctcaagctgactaatagcttcagccccctcgacccagacgcacgtaccaataagccttggatcgattctcagagaagtcttgtagacttctttccacgacctccatcctaccctaccattgccaaaatacacaaggagtggcacatagccttctcgcttttcctgctccggcgtttctataactacaacaaacgccggaactttctccccatctggacgttcagttagtacgaagtctcccaagttgatattctcccgactagctgggcgaagagattcctcgatatggtctttaactttactcattaacttcgtcctcctcacagaacatttcaaaataacaatcacagcataccagcatgccgccgtcatttacaatttcttcgaccgggagaatgcttgcacagcattcacacccagcccgttcaacaccctctacacagacccaagagcccatcttcactcctccttcagaagatactcgttgctaataaccttgaaactaaagtctcggctcatgcttttgaataccaaaccttctcggtacttaccgttcaatgcagactcaccgctggccattttaattacaagctgcatgtcctctggaacgcctacgtcccacatgtacactggcacatgtttgaccgtctcaccacctaactggttcagggtattcagaatggcaagacgctccgctggaagacagtaacggctgtccgaaatgttgtagatatcgtacacatagtattccggtttgtcaactccctcgaagttgccttgaatgttcggtgcaactagctcaccttgaagggcaatattcatcccgaagtaccggagacgttcaccaagatcaagctcttcagccatagcagtgaagtgattggagtccttcttaatcacacgcttccagccacgacccttgaaaaagttcttgacagccgtgaagaatccgattttctcgtcttccagacggaagccaacatttcgggatgcgacgcctacttctccatccttatgccagatagtgagagacgaaccgtccagcttgaatgtcacttcaaacttctcacccctctgatgagcctgatcgtaggccattttaatattctgcacgcgagtctgatccgttttcgggatgaagttagggaaccctagcttggaagtgccagttcggtcgcccttgttaccgccattgatagctgcctgctcagacggctttacatatttcaggatgcccattcgatcagtaacgtcttcgtctactttcggctctggactgccggctgaatgaacaggcacgatcaatccttggctaagctctttgcgaagcttcatggtcttgattcgagaatattcctttccatcccgctcgaccatattacggccacgcaggaattcaaagacaaggttatctacagggaccatggaatccacttcaatgtagattgccagatcaccagcctgatactcacctcgtttgattacgcactgccagccaccaacaagcgccagatcaaggctgtcagcgttaggatgggtcttcacatcgtcgatacgcaccactcgggctagtacgcggtcttgggaattactcatatattatcctccttgtttgaaaattggtatattacttgttaaaccagccgagatcaatagcccgctctagggccagtagcagattctcagcatctagaaggtcacggatcgcgatccaactaccactgtctcccggtagaccgtctgtgatatacacaggtatgtcactgtattcgctctttttaagcccgcaggcacaggctacattgtccccgaagacaatctcgctgacttcccttgcctcgtctcgaatatcgatcttcacacctaccctcctgttgtgttgaaagttgttgtattctgcacggatacctccgctgtgtcaatagccttgacaagaaaataatccgtggtaaagtgggtgacctgctggagagaaatgtccacgtcactcaccggccagcagtatagcgtatgaagaggaaagctgcaagcgcatcctgagtcgaatctgagaacagggcagcgacgacccgaaaggggaaagctcagagcctataaggagcccatgctccccgctcaccgactcatctgcataatgagagcgagaggcagaccagaggcatgtcttaggcggagaatccgtatggcaagccttgggacaggtctgcctccactaccgatctatctgcatacaagagcttgacagtatcctgtaaaccgtgtagagtaatctcaaatcaaccgcagaggagtgtataaatgaagcatgttattcaccgtgaagaccttatcgacctactacgtgatcgtatgaagcttgaagctctagaagctggcggggtggacaactgggactggtatgaggcctcgctaatcgactgcggatacttcgatgacgatggccgggagctagaggtcgaagctcttgcagattgcttcccaaccgtaggtgcgtgaccgtggaggagtcgaaagctaccttcaaagacccttaccctaggttcttcgacgcttctcgtaggtatggcgaaaccaacgactgcatggtggtgagctttgcagtcgtatggaacaccacctatgaaaaggcacaccagcacctgaaagtgaagtgcaagcgcggttaccggcaaggggctactcagaagcgcttcagctacgcagacacttggtgccctaagacacggatgctctaccgggaggatgctaaggataagactcttaggcagtttgctgaggaaaaccctgaaggtcggttctggatcgcggtaaagggtcacgctattgcaatcatcgacggagtgttgtacgatcacactaatgacaagagacgtaccatccggcactgctggcaagtgtggcccggagaggcacctgaaaaaatcgagaggaagcctgatccaatctcacctcctgtgagaaaggccccggactggtatgtctaaacacaaacatctgaagtacaaagaggaggatttatggaaattatttcgagagggacactccctcaagaggctttgtttacggctaagtgccaccattgcctaagcattctccgagctaagagatcggaacttgagtatgtttcgttctcattctgtcgccccggggagactgggtattatttcgcagagtgccctgtctgtcacgaagaggtgtctgcttgggttgcggctcctgtcattcctgtggcaccggccaccacggagtatatcacaaaggagcgtaaataatatggaccagttagcaggattcatgggcgaacctttcgtaattgcgttcgactacgacgagacgatcagtctctaccctcttgccttccgaatcgtcatggataccttcaggggctttggaggcgctttcaatgtgatcgtagtcactgcacgccaccctgacaacagcggagagttagagtggctacgggactacgggttcccgatctatttcacggcacagaaggcaaagcgaccattcatggaaaatcttggaataaaagtctctgtatgggttgacgacaacccgttcagcgtggataatgaccttcctccgtggacggttgagcaatatgaagcctacatggaagccaagaaacaacgagctatcaatcaaaggaggagtgtgtatgaaagttgaagctaatggtgcagaacgtagttttatttcccattgggatggctgggatagtatggacacagcgtgttttggattttatatcaagccggaatatgtcctcaatcctgtgtttgcagcaatgaagccgagcttcctagaaatggactacgagaattgccggttcacattctgggggaacgaggaccaaggtattgaggggaagcttgctacaggctcattcagcctcgtcgagggcgactttgaaatctttgtcaaggacgagtaagtggcaaggcagacatacgaatctgcatcagatagggcggtcgaggaggccgtccgttctgagctagagaatcggtggaagtgctcgcttcataagctccctagagcccactacatggactgggcggcatgccggaacggcaaggttgtcagctttgtagagcttaaagctcggaacaatgagatgcagaaatatcccgacttctttgtgtcccagatgaagtggctccatgggatcgaaatgcaaagggtgtttgacattcccgcattccttgtggtaaagtggacggactatacaggatatgtcaaaatgacagccaatggcgtcaactacatgagcatgggtggcaggattgaccgtggagactggcaagaccaagaagttatggtccatatcccgctgaaagacttcacacgtttataggaggacaaatgaaacgactctgctaccggtgtatgcacttcggggagcccaccatgcaccgccataagacgggcatttggtataagggttgtagtaaatgtggatcaggagtattctatggctaagaagaaccctgtgtttaagtttctgaacacagtcaacaaaccctcggtagagagggataaaaccaaatacaggcggaagcctaagcataaacagaaggagcgattaaatgaagaagggtgacaaagtgaagatcaatgatgacgctgataccatcttccgtgggcgagttgccaccatcgtctcggtagacgaagagggttgtgttatcgacgtgggcaactacgaagacgagagcggagagcttatcgagtaccttcacctgttcttcgagcgctctgagttgtccaagcaggcgtaggagggtataatgaacggacccgagtgcagatggtgcggagagagaactgaagctgagttcgtggacgttgggcttggatggatgcagcaagtcactggaggcatgtgtcatcggtgtggagggtacgagaatggttactaccagaacgacggaaggctcaccgaggtcgagtttgccacctactggagcggtccgttcgaagatcatgcggatttctcaccattcaaccacatgagagaaggcgactcgccatgagagccacagtacgaaaccacaatctgctatacatctacttccacacgttctcggaaatgaatgagtggttgacagagaacgctgtagatcaatggacagtcacgactctgggctccggctatcaggtggctgttcctatggaccgtgcaatgcgggaccaatacgtctctgagaggggttgacacgaacacaaggtgatgctaaactccgtggttgtctgaagtaaggaggttttatgtccaaaatgaccgtggcccaaattgcggctatgcacggtatcgatttgtattctgaccacaagaccgcttgtccccaatgccggaagaaaggcgctgacaacagcggagacaacctaaaggtctatggtactgatcgtaataccggggaacacaaaggtgcctattgttgggcgtgtgggtacaccttgctctctgaagagcaggaaagagacgcccggggagaagacgaagaggagtggaatttcgtgggaactgaatttaacgcagagatcaacgctcaaattaaagagcagtgctcgtatgatccgcgtggttatcgtggcctgtccaaggaaacttgccagtatttcggagtgctacatggtttcgacccggagactggcgagattgcaactcagctatatcctactactactaattatgaactcactggctacaaacagaggatcatgccgaagaacttctcagagcctatcggcgagacaggtaaggattgcgagctttttggtcagttccggttcaagaatagcaacagcaagaaggtgcttattgtaggcggtgaggttgaccagctatcagcattccagatgctcaaggagtatgacgaccggcgagcaggcggtaagagcgactatgaaccgactccagtggtcagccctactatcggtgagagcggggcatggaagcagctacaggctcagtatgagtggctagacaggttcgagcaaatcattctctgtttcgacagtgatgacgcaggacgagaggcagcagacaaggcagccgataagcttccgaagggcaaggtgttcatgatggaaatgaaccgtaaagaccctaacgagtatttgaaagctgggcgtcaatcggagtttgtcagtgcattctatcgagcccgtacatggacccctagcggtattgtcgggtctgatgcactcgacgctcgaatgtacgaagctgtgcaggttgagaagattcctctgccaccgttcgctaagaagctccagaaggctatggcaggaggcatcccgttgggccggattgtgaatatcggcgctgcatcgggcatgggtaaatctactgtagtggatgagttcactctgttttggatttataactcgcctcatatgccgggtactgtgactctggaatcggactgcggggagtacgcaatcaagctgctgagccgtaaggtaggtgagaaggcagacttgtacgagaccgttgaagagaaagtggcgttccttgatcggcaccgtgatgctcggtacgacttgtggcacaaggaagacggaagcccgcgcttctatctgatcgatgaccgagacggaagcctagcagccctcaaggctcaaatcgagcaactgattattcagttcgagtgccgcgtgattattctcgacccgcttcaggacattctggatggtttgagcaatgaagagcaatcggtgttcatgcgctggcagaagggtatgaccaagagccaccgtgtgacgttcatcaacatcaaccacgttcgtaagagtggtggtggtcagaaggctaactcggcaggtgcggaactgtacgaagaagatttccaagggtcttcgtccatcttcaaatctggtgcagctaacattctgatgtggcggaacaaggacgcggagaacgagttcgaaaagaacctgattaacgtgaagctctctaagtgccgatggactggccgcactggaatgatgggcaattggtactacgacgttgagactcatacaatctgggacttggacgactatctggaccgataccctgacaagcgccgtgaatacgaggcttggatggctcagaaggaagaggaaggccgggacacggaatactaaggttgacagaggggtgatgcttatgtatcatccctttcgtcgtttacaggaggaaaggaaatgcaacaacgatttgaaacaatcgagcaatacctcgaatggatgggaaataacaatttcaccaacatgacttgggatatcgaggccacaggcctgttggatgaaacgtctatcgattacactgccagcccctacaagattaagcctagctacaaacaccactgcattgtagtggaggagcacggtggcaatattctggcattctacgatgggccgacctacgtctttgacgggcgagagtacactgagagactgccgaaagcgtcttccatgctccacactgaagaagttgtgactctcaaggactacactccggtagagtatattcacctgccgctgaaagagttcaagaactatgtgctcaagcgcaagatcaagcgcgtagtggctcacaacatgattaacttcgaccttatgtcgatgaagcttgtggaagatatggactttactatcggcgtcgagcacagggatggtggtctaactacttggtcggcagatacttggatgggcaagcaggtggtattcgacgataccctcgttatatccaagacttgtaaccctgacctgttcggcggtcacagtctggacaagctgtctcgtcgcgctggtggtgacaccaagattgacttccgcaagcatctggcaccggatgttcgattcctcgacttcgctgccgatatgctttactactgtatctatgacgtaaaggcgaacaccgctgtatggcactggttgcaggaccacgaagattaccaactgtccgaccgagacaactacatcaagaactggttgtcgccgattcagttggagaagaaggttgcagagataatcacctatcaggagcaccgtggcttcgtactgaatgtggacctctgtgagaaggccgtgaaggacttggatgccaagatggaagagcgtcgtgcccgggtagaacctgtgcttcctcctcgtcctgcgactaagaagttcatggctgattacacaccgcctaagcggcagttcaagcagaacggggagatcaccagctacttgcagaagtttattgagcggattggggctcagttgaaagagggtgacgaccggacgatgatcttcgaaggcaaggagtacaagcttccgcttcccgctgacgtaccgctgaagacggaaatgcctgctaagatcggggacacaactcacatcaagcaatggcttatgggtgagtttggttggattccatcagagtggaaagagactgatctgactgtggatcagaagaagatcaagcttccgatggaaaacatcgttgctaagatcgatcgctggctggatgtaacgtatagcacagcgtacaaggaagagcggctggacgggttcggggattacatgaagatcacccctcgtagcacccgcgcgtatgtacgtcagaggttgattgatcgtgcaagcaaggggagctgtaaggttctcactaaccctagcttcacaaagggccaagagaaagaaatgtgtccagacctcgaacgcattgcagaacagtttccgttcgcgaaggatgtgattgagtacctgacctttaagcaccggcgaagcgcaatcctcggtggcggcatggactgggacgaaatggaggatggagaggagccggaaaaaggttaccttgcaagcattcgtcaggacggcaggattcccacgcctgctgacacttgcggggctgctactagccggatgaagcaccggaaggttgctaacgttcctcggatcacctcgttgtacggggctgagcttcgagagttgtttggggttggagatgggttcttccaaattggatacgacttcgattccttggaagcacgtaaagagtcggcctactgcgatcagtacgatccgacaaaggaatattgcaaatctcttatgatggagaagccatttgacgttcacacaatgatggctaagcgtatttctgagatcattggtcgccaatttaaccgatctcctgcgaaaaacgtaaaatatggattgactaagtaacaacggtccatgtaaaactgtgtgaattcaggggacagccagaacggccaatcctgagccaagctagagtgatctagaaaggtgcaacgactatcgaaaccacggcgggagccggaagggagtagagtagggtcaagtgacccgaagcgcacagggcgcgagagcgtcatgatatagtctggtctgcatggggacatgcagcggtaacccttgagcaaggttacgggggaggattaacgaccctccctgaacacaacggtacatacggcgctcaagctggtaaagtggcgaaaaccattggtgccgacttgcaaactggtcaactggtgtttgatgctttctgggatgcagcattcccattgaaagcactgaaggatgacctaaccaagcagtgggaagccaacggtaagaagtatattgttggagtggacggtcgccgagttcctactcgttcggctcacgctatcctgaacagcttgttccagagtggcggtgttatctgtgctaaacgtgctatggtgattcatgaccaactgctggagaaagaaggtctgaaggttgactttttcaaagaagactggaagaacaagccggaattctgccaacaaatgatcgcgtaccacgacgaagcgcagttggaagttacagctaagtcggttagcttcaagatgttcccttggtcccttgtaggcggtaagccggaaggtgagaaggagctagaggcagccgagaaggagttgaaagctctagctcaggcttacaaggacgaacaattggctagcactggcaaggtgtggagtgatatcgcacactacagcaaaggtgaaggcggggtgtttgtagcttactgccgcgctggagaacttgccacgaaggccgtgagagctgcgggagagttctactctacccctctggtgcctatcgagctgaccgctggctacatcgttggtcgatcttggaaggattgccactaaaactggcattaagcgaggaaaggggcttgacaggcccctccgcctcctatacaatggccacatattcacgacacacagaggagaaaaactcaatgactctagcttttgttatctatctcgttatgaccgtattcccagccttgtattcggcagggagttttaccttgatagttactatcatcgcgtgggttgcaggagggtttgtttacttggcatcgattggtggccgagaaaatgaggcagttaaagctacactcaaaaatcacctccggcccttgacattcaagctgtttctacctatcattgtaatcggccatctagtcccctcgtctgaaacggcatggtggatggttggcgggtacgctgcacagagcctctatcaagcagacgctactcagcaggttctcagcgaatctactgaactactcgaagctctggttaagcgggctaagaaagaaactctgaaggctgttgaaggcagcagcgagtaatctacagaataggaggtatggtatgaacacggctcgactctacgtctacggcaaatcgtccatggtagggatcactgttgacaacaaggccaatcgagagtactatacctctaaaggcttcgaggtatcggagacaccgttagcccacaaaagcgtggctaacaaatacaaacagaaaggaggtaaataatatgtctggtattatccccgggactatcgtcaaactcactcaagtgggatgtgacgtcacccatggctggccaaatgaagcccgctatgtaggcgcatacgcagtagcagtagatggacgtgatatcggacttgcgggagatcaaatccggttctgctccctccactggtccattgagcgagatgttaatgatggactcggagactaccaaatgctggtagaggatgcaggccgctacgaaattgtagcagttccgggcaagaagtattacgttaagaacgttgccaaggacagcgcacagatcggccattacttggttccttcggagccagccttgtacgtaggtttcgagccgtgctggctgaagagcatgcacgaaggggagagcccgttctgcatgacttttaaaggacgcgttgacattggcggtgaaacctctgacaagccgcagttccagaccctctaccctgagctggtactggaagagtttaaagaagaggtggagggcaaggttgaagctccggttgacgaagagaagaaagaaaaggttgcaaagcctgctgtaatgggttatgctgttctcgatgtagacggaatccctcttaaattctgtctcactcgcgaagaagcccgagccaccaagcgctggtggggtggcaaggcggaaggcgtatcgattgtgaaactgattaaaggagaggaggtgcgctaattgcgctaatcctcttgcagaatccgggaatgtccggtatgatcgtcggtcaagtggctgacacactcgcccagtctagggtacttaaataggagaaataaaatggcttttaaactgaacgtaactaccaacactcaatccggcaacggcggcatccgcaaggaagtcgattgggatgctctgaacaaccacgtcgtggaagctgctggcactgccgctaaagcacgttcgatcccgggttatatctccggcatcatcgacctcggcgagcaagagcagaacgatgcagaggttgtgttcactggcactgccgaagatgaaatccaaatcatcaaggaatacccgaacacttacttcaaggacggactggacaagcagactcgtaaaccggtacgtctgaagtgctggccgcagcgcgatatgcaacaaatcgcgatcactgtggacttccctcagatcgaggtggacaagagcctgtacctgaccggtaacagcaacaaatctccgcttcgtgtcctgtacaacggcgactttactctgccgggtcagaagactaagattgttggccgtccgttcaccatcaaggaagtgaagcacccgaacggcaaatgggcgttcgctaagaactccatgctgcacaaactggctgtagctactggcgtcatcaacgaagacgaactcttcaccaaggaccgcgtaggcgagcttctgggtaaagtggctcagttccaagttcgagtgtggatgaagccgggcaaaaacgacatgaaattcctcaccgaggatatcagtctggtcggtatggtgcctgaaggtgttccggtccctgaactggatgagaagtacatctacggcgtgaacctgtatggtgagaacgacgaagaggcagttaagcaactgcgtgccaacgtcatcaacaccatcaagcgagccaagaactacgaaggttctgatatcaaggcgatgatcgaagctgttgaagctgcacgcggtggcaaccgctccagtggcgacagcgaagagcaagctgaagataagccgcagacccaagctgcacctaaagtggagccggttcaaaccaacgtagatgatgacattccgttctaaagggcggtggtaagacaaggggcttcggccccttcctttcaaaatttcaaaggaggcaacacatgcaaatcaattttggtcccatcttccttctcgcagcaatcgtcctgtgcgttctgaaatctgccggagttctcgctatctcttggactgtggcactaatgcccatctggattcccttggtgattgttctatctgttctcctgctgctgcttgtagttgcaggcctgatttacgcattcggggatcgtagtcaactaaacttcgcctttaaaaagaactacagccttaaaaagaactttcgaaataagtgaggactaatgatgagcaacttggttattgttcgagtacctgagtacattctgaaaggccccgcagtacaaaatcagtttagcggtgaggtgtgggaacgagagcttttcaaggatttgaaagaagctgcgaaaagtatcattgaaggagagccagcttatgttgctcttcctaacaaggtaaaccctgacactctacaaacagagtgggacattcaggttgtacagttctaacccaaggggagcttcggctccctttttcattggagataaaaatgagtgaaaaggaagaggatatcgtcctcatcgacggcgaccttatcgcctttaagtgtgcaagtgtcaacgagacccgctccatcattgtcagaaacaagctaacaggagaagaggaaacttggaagaaccgcacgacatggcgagagaacaacaaagacgaagagggattcaacgaggaaaacttcgaaattgaggaccatcaagaccccaagcacgtatcctatggtatctctgttgttaagaccatgatcgaccgaatctgccgccaagctgggtgcaagcagttcaagattctcctatcaggccctgataacttccgtgacgctatcccactcccgaaagaatacgagattaccaagggtaaaaagaccttcactcgtggcggcaggtacaagggtaagcgtacagggcagattaagcctcttcagctaggtcagctaaggcagtatatgatcgaagcgtatgacaccatcatccatcccggagaagcggacgacttgatggccgaaatgatgtacaagaacggtgtaagctactccagaggggagactactcagcgcgtgatcggggctaccatcgataaagacgcagacggcactctaggatggctttgtaactacgaacgtgagcctgttcaagtcaagttcatttcaggcctaggatcgctctacagggactctaagggcaaggtgagaggcgagggacgtaagttcttctacttccagttgctattcggagaccctgttgactgttaccgtccggctgacctgtgtatcgggaaggacttcggggaagtggcagcgtttaacatcattaatccctgcacaacggacaaggagtgctggcaagcaatctacgacacctacaaatcgtggtatcctgagcctgtcacctacacagcgtgggacgacacagagcacactaaagatgcagtagagatcatgcaaatgtactgtgactgtgcccacatgcaacgctgggcgggagatagagtagactgtaaggctgttctggctaaacttggggtagacatgggaggtgcagaatgagcgtaaggccgcgtccttgggaggacttcccgggcatttggaagaccgaagccgcgttcttgagttgggtcagaggtggcattcgccgctacctctggtctaagaacccagtcaagcttgagtttgctaaatcccgaaggatcaagatagccaacaccaatgaaaagagcaagctcaggaatcccactgtatggggttacgtatgcgagcagtgtggaaaggaaactcctcaagctaacgtcgagatcgaccacaagacaggagaattctccctgaagcgagtagaggatatccaatcgttcgtggaaggtgttgtatttgtccgaatggaggacttagctgtcctgtgtaagccgtgccatgagatcaagacctatgcagagcgttacgggctgaccctagaggaagcagatatcgtaaagcaggctattgcaatccagaagcaaaagggatatgataaggtcttcttgcaggaggtgggaatcaaacccgcatccaacgcagagcttagaaaagagcagatcattggataccttaggtctaagaaggagggtggatgaacgaggatcgggtttacattgtagtaagagacgaggcaccagaatacatggtgcctactctggttgcacatagcatcctaggggcagacatggcaatggttctcctcggacaggaccgggccgttccatcgacggaccttccgtcccgtccgtatatgcatgcagcggcaaaaaccgccattaagtgggtggagtggaaacagtggagcttccgtaagatcgttgtacgagtttctgacaaagagtacaataagatcaagcaaatccccttcgtatatgaggggtatgagagaaccatctgcaacggaaagggctcttgtctagtagtgcctcctcttagcaaggaggagactccgaatgttcttaaatttgcaaaactgtggaggccgatgtgagggagaagtttcttaaaatcatgcgaaagctgccaatcagagtacgagcctctatcgttctgatttggatatccatattcttctggctaccggttgtaacagcactcatcgccggaattatagacctcttctgtaccgcaaaggatcagttggaagagggatattcggtactcatttccgcaactatgggagcgctagagtgtcttcgtacaggggaggagctatgacaagtcttgctacttatgttatccgccacaagaaaactaaggagctttggactactcctaaagggaagcgtcaatggacaacaaaaggggctgcggctctagcttggagaaacgcctacgagggtactgcacacggagcgtacgttgctagaaaggatatggagcgctggccggacctaagcatccctatgattgtagagaatggcctccatcgtttggccaaccaagaggccgcagctttcaagaatcaatctgctttcgagattatcgatatagctgagtctctgaagaacgagagtcaattggtactcgacttgctgaaagatgttgttggatttgaagtaccggactctgttggagacggatacgtgcgtctaactattaaaacatccacatatgacgatatcatcaaactactgaaggagacgaaatgagcatgatggaccctaaagcatacttcatcaaacaagacctagaggaagccacaaagctcctcgaaagggcctacaatctactcgacaacgttcattgctatgacacggctgtgtacgaggacattgcagcgttcctctacggtcaagagtgcgaggaggcagagtaaggtgggaatcgatcttaaagaagctacggatcaaataaaagacttgcttgtagctgtcgctctgctagatgaagtccttgtgtggatggagagcgaagacctgtgcgatgcagatgtatacaaacgcatagacgcatttttgtactaccagccgggagaaggcgaatgggaggaggtagaatgagcagtaagaaacactttgtaatttctgacacacaatgcaagccgggtatcaatctggactacatggaagctattggtaaatacatcgtagccaaacgcccggatgttgttatccacattggtgaccacttcgacctagccagcctgtcgtcctacgataagggtaagcgctcctctgagggccgtagatacgccgaagacgttcaagtcggacgtgagggtctggacaggctgttcaagcctctgtgggagctacaggagcgtcaacgggctaatcggaagaaagtgtaccaacctcggttgatctttacactgggcaaccacgaagagcgagcagaccgggctgctaatgacaaccctgagttgtatggcaccgtaggcagcgatgagcttggtattcaggactacggttttgaggttgtcccgttcctcaagcctatcgaagtggatggcatctactacgtccactacctacaaaaccacttcactggtaagcctctgggtggtacagcgaacaacatgctcaaggcggctggtcattcgtttgtcatgggccaccgtcagcttctggactgggctatccatcctacaatcgacggaaaacaaagacttggcattgtgactggagcgtgctatcctcacgatgaagcctacaaaggctatcagggcaacaaccacttccgtggctgtgttatgattcacgaagtgaaggatggttttggtctacctatgccagtaagtctggacttcatgatggagaaaggaggcttcaaatgacagtttataagttctggtgtgaatgggatatcggtatcaatgagtgcctgtggcgagactactaccagatggaagaggatgtagctaaagccttgtcagactgcgggattgaggatactattgaggaactagagggtgcaggcctgcttggcttcgactctgttaaagtgattggttaataggagggcatatggctgagtttttccttggggcggcccttgcaggcttgttctttatgtttagtatcactgcgagctttaccgccgaagatattgagaaagtgacttcaacatgcgagaataacgaaggcgtcaagtatttcggagttgacttcttcggagacggtgctgtacactgcaacagcggcgctattttcaaaatcgaccgcaaatctaaataatcgaaaaggagatataaaatgactgatttcaacatcacccctgagcaaatggaagaagcaatggcaggtatgaacccggagcagcgggctctggtagagaaagccttgaccgaccgtaaatctctggaagattccatcgtgaccgaggacggtgaactggactatggcatgcttgcacgacacatccgcaccagcttgggtgatctgcctctggtaatgggtggccctgacttcctgaagctgatgatcttggttgctgcgatgccggagaccaaagacgatctcctgactctgcacatgaacctgtccttcattctggactgcattcgtgaatcgattagcgacgaggagtaacaagtggaagagattgtaaaagacgaggctgccctctctggagacgatctcatggttgactcggcagggcttgatgccctgctggcgttcctagagagtcagtttaaaggtccgaagggtgtactgaagggatatgtcactatgagagtgatgtgcgctaagatcgagagtcttgacgggtttcaagagttgaaagatatggaggtgaactttgagtaacgatatcatcgacgttcatgctgggcaaccgatttctctggtgcaacggtcaaagaatcctatcaatattcaatattgggacgccgataccatcccttacggcacagtcttggttgttaccgaggaaaggggtgatatacgaaagggagaattagtcgtaaggctggctagtagtgcagatgatgagcactctgttagggtatgtagattctctgatttcttcctcctaatggagaggggttatgacgcagccagtctcggcgacgttaaacaagcgtatgatgctctgttcgaagatcacccagtgactacctttgtcaactgggatcgggctcagcctttgacaaacagtgagcgctactacggagactttctgattggcggcgaccctaaagggatgccactattcaacatggctgttcttaaaaatgttctgtcgccttacactgccgacgatgaggaactttcagctatgtctgggaatcccgagacagtagagcacaaagaagttgacgaactaagtgagagggacgaggctttagccgaggtcgacagactcaatgaagagcttgttgcactgggtaagaaggttgtgttcgccaacctagaagattacctaggcaaagaaaactatgccacattggaagctatggctaaccacaaggaggctgtaggtagcggaggctcctctagttactacactgtcaaggtgaacaaccccactacgaaggctaacatgccgtattttgcagagtgcaacgatatcatcgaagcgctggatatgcgattcggtcaaggcaacatgttcaaagcgttgtggcgggctgcggcagcacagaacctaggcaagctgaaggccggtaacgatgttatccgggactacgagaaagtcatcttcttcgctcagttggagatcgataagattctcagagaaaggggttgacattctccccgaggcttgcgataataggctccaagttgaaacgaaggaggtgtgtagatatgatccagaaagtaaaacagaagctcatggtggtgcatcctgtcctcgctagcgagatcgtctggtgcctcaccttcgcaatgcttcagtaaaacaagggagcttcggctccctttattgtatcaaagatttaataaggagagtttatgcaaatttctgcaaaagtgattcaacacagttcccggatcggcctaggtacgaagaatcacagattcatcactacattcgaactggagtatcctcggtttattcacagtgaacttatgactcaccgactttttagtcgaaatgctgcaagtagtcgtgccattcccgttgcccatatgatccgacaggtggaagagaatcctgcgatgcctgttcactggggaatgaatcaaccgggtatgcaagctgagttcgaactgagtgagtgtttgcagcgtagctctcagtacctgtggaagaaggctgcaaagagtgcggctcggatcgctagcgcactaaataaaatgggactccacaagcaggtggttaaccgtctccttgagccattccagatgatgaagaccgttgttacagccacggaactagataacttcttctacctgcgttgccataaagacgcacaaccggagatcaaggttctcgctgagaaaatgtatgaggctcttattaaagcgggcccggcagaggctctatatgacggagagtggcatgttccttatgtgactcggttccgcataggggatggtaagctgcgttacgcagattgtaacgggcaagaactgagcgtagaggatgctattaaggtatctgctagctgctgtgctcaggttagctataggaagaacgacgagactctggagaaagctcttgtaatctacaaccgattggtagatactaagcccgttcacgctagcccgttcgaacaccaagcaacaccgatgctccgcatctcggacaatcaaactggatgggaagacggtgtgacgcacttggaccaatatggtgacctctggtctggtaacttccgaggtttcatccaacatcgtcaactaattaaagggcacgtatgtaatgagtactacggccaagaagaggaaggagtttaaaaatggcagaatataacctgagtctggaagacctcatgctggtcgatggcttcaaagaggcgttccagagtaataatgaaaaagtagtgcgggagcatctgtggactaacggcatggatgttaaaaactactcgtatgaaatggttttctgtcagcatcgcaccctgattggccgagtcgtagagggtctacgattctctggctttgagcgtacagacaaggagtggctgagcctcggttgcgcctctctggaagctcatattgcagcgtgtgatgatagcaatctacggttcactcttcgcaaaatgcgtccagagggatcgacagaggcaacgtttcacaattaatgcagtagcagtagaaatagggagtgggtatggaagttacaaaggcgctcgtagacgaggccgatattttcaataagatcacacaaatcaggactccaacggagtcctatgcccggaaatacccggtcattgtcgaactagcaaaccagcaactagaagagaagttgtggttctctagcgaaatgaaggtagagctggataagttgaacctgaagttcaagttggaacctcatcagcttcacgctgtaaagactgtccttcaactgttcctcaaatacgaactgatcgtaggcgaggagttttggatgggtaaagtagtccgcacgttccctcgcccagaggttaaactagcggcttcgatcctgtgcatgatggaattggcagtccacgctgaattctacaaccagatcaacgtagtgctggggatggatacagatgccgactacgtggcgtacaaggatgacccggagcttatgggacgtatggagtggcttgagtctgtgctaggcgacgaagacgatgttctttcggtaattatcttcagcctaacagagactgcccttctgttcagttctttcgctatcctgaagagcttccagtgcaacgggtataacgatatccctgtcatcgcacgcggggctaaccagagtgctgtggatgaagacttgcacggtgtagtttcggctgagatcatcaaccaatactacgcagagattggtcgaccattgtctgaagatactcggcgtgtcgagaagattcgacaagctatcgaccatgtatatgctcatgaatgtcgtattgtcgatatggcgatcccgggcggagaacttaacggcgagtcggctgaaaactataaagcgtttgttcgttatcgtttgaacgtatggtgccgtcgtctgggtctggaagatcatttcgagaacgatgacactccgatcaaagattggttcgaaatgaacacgtacgcttacaaaatgattgacttcttcactccgggtatgggcatggaatacgaactagggtgggatgaagaggaattggcaaaggcttgggaagaggagctgaaatatgagtaagagagacacgttcaactattccgaagctaggaagaacagccaagcaaccggcgagactcctctatggtatacgacggctggctaccagttgttcatgaagaagtattcgaacgagggcgagtctgtacgctctcgcttccaagctgtagctcgcgctatggctcagcacgcccctacggtgtatcctgagtggtgggaggaggacgaatacactagaggcaaggactgggaacaggtattcttcgacgttatgtgggacggttttgtaagcccatctacgccgcttctgtcgaatggaggcctccgtaaaaagggcactacggtgtcttgtgctggcggtctgatggacaacaacctctatgaccgttacaatgtaatgacagagatcgcagtgctaacgaagcacagccatggcacaagctttagcctgaccaactggccatcagaaggagacgctatccgaggcggtgagtctcaaggtgtgatgcctgtcattcgggacgttatcaacgtcatggaagaggtagcacagggttctaggcgtggtagctgtgcatacagcatcaacccccgccatggagacttctggaacgttatcgatcacctgtataagcgcacagagtcgaacaacgtcggatggcttctagacgaccagtggtgcaaggatatggccgagaaagacccggagaccttgaagcgatggaagcgaatgatgttcgtcaagctggccagaggaaaaggctacttcacgtttatcgataagatgaatcggcaccttgcagaaccgtttaagcgggcgggtctacgctgcgaagcgtccaacctttgtcaagagactgttctcccggcaaacgactggtatacttttagctgcgttatcctgaactacaacctcgaactttaccgttcttggcctaagcaccttgtgtttattggtcaggttatgtctgattgcaacatcagcgaatacctagcaaccatggatgaggtcagcgttcaggaccgccgagcactggagaagatttaccgattcaccaaggacttcagggcgcttggcagcggtgttctagggttccacaccctgctacagcgggagcgattcccggtcggtagtatggatgctatgttcctgaacaacgccatcttcaagggtatgaaggagcaagcggaagcttgtaacagttggctagctgaggttctaggggagccagagggctgccgtggactagggaagcgtaatgccactacaatgatgatgccgccaactaaatcgacggcagaactcatggctggggcttctgagggcatcggactggacgttgctatgtgcttcaccaagcagagcgctggaggtgaattcttccgtgtcaacaaggtgttgctggagattatccaagagcgaggcctcgattgggaagagtgtgcaaggcagattaacgaacgtaaagggagtgttcagcacgtagactggctgacagatcacgaaaaggctgtgttccgtactgccttcgaggtgagaatggaagactacctgcgtctgtgctctcagcggcagaagtacatcgaccaagggcagtcgatcaacctctacttcacgtcgaacgactcgccggcttacatttcgtacatccatcgtctggccatggaagaccctaacatcctgtcgctatactacatctatagtatgcgaggtgctggggatatctctagaacagaagaatgtgaaatgtgcatgtaaaatcattggcccggggcttgacagcttccgggcctttgtgtattctgagcccatcaaaacaaggagggactaaaatgaacaaattctctgaagtgtactacacttggagcgcagcgtgctctcgtacaaatatcttgatagatatgggatggactgctacaatccgtcgagacttcactggcgggatcaaccctgtatgggttgtggagttcacgcgatgaacagcaaactccgcaaagagttcgataaatggtggggacaggacgagcaagaagaacttcgtaaatcctgtgccaaaggatgggcggaatatatctggatggctagtcgaagaaaagtgagtgttgagcttcccgcgccagaaggcggatttatcgacatccaaaagtacacaatcaatcgctgcaaagaagctatccgcgaaacaggactggaggtgttttaatgaaagaatattttaaaaagcgactaatgcagaccagtgaaccgttcgattcagcgacgcaagctatggacgtagcgattgcgtggggaggggctaagtactgcgaattcacttgcgtaactgcggataatcgcgtcatcagcatctgggagtacaatgacgtagagcctgataaaccggtattcaatggacagcaacgaatcttagttccaacttttgaggaggtagtataatggaacaaactattgataaatctcggtatattgtgcttgataacgaaggtcggcacgttctgaccttgtgcgagaaggccgcctataacctgcttaaaggcgttcagtggacaaaggacaagcatggtcaaatccatgtaaatggtgtcacaggcattgaactcggagttcgtcaagggattatcgctgaagtattcctgtatccgggctacatcatcctagaagaggtagactaatggatatgttcgataaatacatgcaagttatgtatgaccgggacgctttctcaaggcgagtcggtgagttagaaaaagaggtagccgaactcaaggctaaggtggctatcgctaagtgtgatatgcgtgtcgtgaaaaccctactggaagatatccaatgggtgtatcaagacgaagctatctatactctaccgggctacgtttgcccttgttgcggggaatctgcaaactatgggcatttccaaggcagcttcgataagagcccctgcctactagcttgtgtactgagccggagtgaagcatatgaagcctaatgttgtagactcgctaggcattaacatgtgctacgcctgcggaggtaaactgtacgtccgaggagtatgcactatctactgccctgattgcgagaaggcaacgaaagataaaccgttcgtcaggatgcagcttctacaggatatcgaagacagcaagagggttgacaacgaatagaagtgctagtaagatggccacatcagacagaggaggagccatggctacaacagagaagatcatcgagtatgtctcggcctgtatcgaacgcttgcaagaggacgtaactggatactcggagaacttccgtgacagggcgttatctaatcgcacagggtatattcacgggcttatcactatggctgaaatgaatgagcaggtgagtatcgaggactgtgacaagctccgtgcaaagcttcgtgaagctgctgaggctgtgttgaacgtactggattccaaaattaactaggaggtgttctgatgaatatgaaagagattgtgcaggcttcgattgtcgttgtcgctctgactctcgcagcaataggttttgtagtcgggattactgcgttggccaacaagagcgcgcccgccgaggatattgtcgtgtctactgaagacggcaccatcaatctcggtcgctccgtgaagagcgagaagctgctgtatagcatgtgcatcaaggtagaagaccgtaaacctgcttgtgaattcaccaccaaggaccgtgttcttagcgaagtgaaacaggttatgcgcccgggcgaggctacggcccgcgatattaagattgcagtaaacgcggctgtgacgtatactggtgagaacgggcaggaagcaacctctctgattaccccgaaaggtaagtatctcccggctggcaccccgtctgaagtgcatattcaagagattgcaaatttgttcgacagcgtgtacaatgactacaaacaaaacttcagcaagatgtgaggaggactcatgaaagcacagcctaaagaagtagaaaccctgtccctcgacaagcgccccaaggcaggtgatgttgttcgactgcgatctgacggtaaaacctacgaggtaaatgctgtatatcccacggcagtgggctgggaagcgattctccgcaacatgtacgacaagactaagaccgtcactgtcagcatggagtggtgaaatggcaagaaccgtcaagtgcgtaaacttcctacctgtcactccggacggtcgagtaatcgtccgattcggcaagaagaggctaggctggcttgggaaacagggtaagaagtggcattactacccttatggatgcgaaggcaagattaaatcagaggggtttaaaacactcgctgaaatcaaggcttggattcgagaccccgatgctgtctggcccggtccaaagcctgagattgactaattagccgacgaatggtacaatggtatgtaggaaattccctactcaatataaggaaactagcaatgactagccgctggaaagaggccgtgtatcgtaagtactcggtgcgtcgtctgcggcaggaactcgaagagttcaaagaagctagacgctttgcaccaaaccaacgcatccgtgcatggtttgatgctcatatcgaatttctagaacgccacttggctattcgagagtccggccaagcctacccagacgacctttggtaattaggtaattaggtgtgttgtaggtagagattcaaatcatggttagtggcaaggacgccacacttcagcccgcccacaaggcgggcttctttttgcctgaaatttgaggttgacaaggttggccggaatatgtaaacttgcggcatccaacaaaggagggaagaaaatgcaattcaatatatcgaagcaactatgggtagctaaaagcgagcggaagggtgactataaagggacgcttttggcatacatgtctcaagtggacttcaataaagatggtagcttggctgccagcttcaagaaaaagcagcagactggtatgagctgggcaggtaagaatgccgagacttgcttcatagacaacatccctatctcggggcatttcatcggggacagtgttgaacgctgggtcactgagaacaaatatttccgtgtgacggaccctaggggctttgttctagaggttcctaccgggaatatctcgaccttgctctacaactgcacagtaatcaagggagttattcaagagccttgcgtgtgggtgcggatgggttctcagcacgttctactgccggaaggctcctctctctacaaagaagctgtaagtttcgtagagcgaaaagagtcggccaaaactgttaaagatatggttgcaggggatcgatgcactcttcttagctacgggacagaggagaaactagaggctatctacctcggacaggtgaagatcacttggcacctcctagctaaaaagggccggtactctagccgagggtggggtgggggtcggtggggttaccaccatctagagagggaactagatagaaaagaattcactgagaaagattcgaagtgggttagtgtgttcgctaagccggtaggaaagcggtggagtatccattttatcctgtctccaaaggcaaccgacattcaatctggaaatgtaccggatgaacttcaaaacctcgacctagtgaatggtgtaaaatgggagtacaacgagaaagacgaccgcccatcttcctattactctgtaccggatagggtagtcaagtgtatcagtgtggatgatcccctgtgggataagctgcacagctcttcggaggtgcggtggacccgcgaatggaccgtggtcggagcagagtggcgaaaataagccaccattattttagaattgcccggcgagagccgggctttttcgtggcaggggttattttcaaattatttttagatttctgggagtttcggccaatatgggcaatatgaaatttctcaggaaaaggctcagaatgctcgtataatagccgttcgagtgtgggcagggtgagctactacttagccgtagaaggacagtgtgacgcttaataggagggttagaatgaagattgacaacggtggcgaatatgcgtattggctagcggatatcaaagagtttgtttctcagatggatgccacagagatcgagaagagggcttgtatagcatacttaattagctggtatcagcgaagagtactgcacagaattaaacgggagggatacgaggcgatctaagctagggaccggatggatttttagggactggatagattttcacaggctgcaaaattaggaactgggcagatttttaggaactggacagtttttcacagaaggggatttttctacagaggaatttcccctgaaatttagccggatttctcagaagggcggatcgttagcaggctatctaattggttagcaagctacctttaatcgttagcacactaactaaaaattcctaggacggacctcagttggcacgaacgttgcaagcccgcaccagtttcccgggcaggcgtaggcctcgactatccgtcgtgaaggcgatatgtagttggggactcgcaccccgcgtttaagatgcgcccattctattatgacaaacccctttgtcaacataattttttatggcacagtctttgcaattgcaattagcgtgccagcctaaatctcaggctccctcggtgtttatctccggtgctcggcctcctgcctgcgttgcccgcctgcctgtcattatacacaagcaagaaaagaaggcaagcgaaaatatagagaaaaatctacataaaaccggttgacacgttccttttatataggcacaatgagcacacattcaacggaacggcaggtaaacagccatgctacatagtgaagcccgggcgatggccctacaagagatggacaagtggagcctcctcgaacaaggttggaaattcagtttcaatctcaggatgaaacggacgctaggccgttgtaatcacgctaaaaagctcatagagctaggttacagctacgtagctgccaatggagtgcctgcggtattagatactatccgccatgaaatagctcacgctaaggcgggaccggatcagggccatggattcgtatggaaagagtggtgcggattgattggcgctaaacctaagcagtacgccagcacaaaagaaaaagtagttaatttcccgtggcaactggcgattcagcacgactccgggcgcttagagcggcttaaccactacggtttcagacggaccaacatggcgaaaaagcaggtacgcgggcggcctgagacaaagggcagactagtttgggtgaagagtgaaaataagggttgacagcttgggccattcgcgtagaatggccctcaagcaaagggaaacaccctgagcagtcacaaaggatacatagttatgaaagcgctttgtaatcatcgggcactctacgcggcttacaatcgtagcgagattgatcgcgtagcggtagacttgaaccgctatttccctatcgagaaagatgatgaatgggaagacggatcatatatgtatcgtcgccgcacctatctggtgaagcattcgaagggtacagcccgttggcacagtctttactgcaatgggatcgtccaaggcgttggcgtcatcttcgacgtgaaatcgggtgaacctttccgcacagcataaaggagattcagaaatgcaagcttggaacgtataccagaacggacagttgatcgatattgttttcttcgatattatgtgtgataccgaggaggtgcggaaatctctggtaaatcatgatggatacccatccgatatcactgtagaggaggccgagtgatggataacctttctgttaaaatcgttctgtcggaactgagttacaaggccttgattcaagccttcgccttgcttggtcgaacgctcgacctagacgaagggttggacgatatacttaatcttattgcggatgagatcgctttccgcgacggcctgccgcctttcgcagacgactgcgataaaacagaatggatgctccgtcgatgggaatcgctcccggtggtatcgtacaatatcgggcaggacggaccgattgtcgctcggtctatcgaagtaaaaacggcatgaggggagaactgatgaccgtcagagtaggagatatagtggctatccggggcgacattcggaaaaagctcgacggaacgtgccaatacacgcccgaacaattggtaggtggtaagttcctcaagcatgccggcacgggagaaatatggactggccgagtgagtaagatacaaggtgatatggccaaggtgggaggggcttggcgcgggatcgaattctatgtgctcattagtgaaataaacgcttgacaacctgacccactagctgcaaaatagcacccacagacaacgaagacgccgataggcgaggagaaagcagatgcaaatgtttttcaaaacccgtacccaagcccgtgcaatggccaccaatggccgtaaagtggtagacaacggcgctcaagctgaaaagcgctgggctgtcaagctgaacaaaaaggaggctaagtaatggctaagtctgttagcgtagaccgcaagcggtccattctcgacgaagcgaaggatggcagtttcttcagtgtggagtttatcaaggcggacggcaccgttcggaaaatgacgtgtaaacgtcagatcaagtcggcgtatgctaacggccagtttgctacccgcaagcccaccagcgctggcaagccgcacctgtataccgccgccgaggtgctgaacatggaagagggtaaatccgctttccgcactatcaaccttgagactctgacccgtgccaaggtaaacggaatcgaatataaattcgattaaaagcttgacagcttaggccattcgtgtagaatggccctcaagcaagacaacaacctaagaggctatacagtgaaacaaggtactgatttgatcgctaaagcaaatttcaccgcccgactcccgggagctaagcgggggatttcggtcaagccgggagataaattctgggtaactactccgtcctacagtaacaccgatttcgtaggcgtagcgaggaaaggcaaaacaacctcctaccttttcactgctaaggatgtacaaactcttttcgaagcagtataatcttcagacccactcaaccaacgcttgacaatacaggagatttaaaatggcacgttctatcaaggcttccgacttcgattccgcttaccagttcgaggccgccaaacgttccgaacgtaaagaatcccgcaaatcgcgtgacaatcgcaaagcgagccgaggccgagctttcgacttccgcgacgatatctaagatttgcgcctagccggtgggccgattcgccggcaatcctaagcccattcgtcgagtggttttaggattctcaaccccagcggagataccaaaaatggttcgtcaatgcgtaccctgtcccgatgctcgccatgctttttgccttgcttggctattcgccatgccggagttcgccggtctgcccgctcaaaaggacataaaactctttaagacttcgggacagtgggcggtatgttatggctaggcgtcaacggctaccgtcgtgggtgcaggaccagaccgaggacgatactccactccgggataagatagacccataccttagcaagctcggcgaagtcgataagctagagggacaattgcgacgggtcagggatgcaacggacccggacgaatacaacgaaatggctaaggtactaaaagcccgacgccggaagataatgaagcaacgtgcccgggcctacggtctgccagaggatgagcctaccaatgtccaagggtacagcgtaccggaagaggttcaccgtagagccatcctgttaagcagtgtaaaaccttggatgttctggaccatcctgtctttctcgatttttgtgtggtttgttttgaaaaacagttgacaaggttcccgcctcctgtagaatggtcagcaagaaaggcggacaggccgcctagctagacaaaggacaatcgtcatgaacttcactctcaatctcgtttccaaaaacagcaaaaccggtcccatgcctgttagcacgtctcataacggcacctgcccggatgcctgccctctcaaggctaaaggctgctatgccgcttatgggcctactgctattcactggaaaaagctaagcaagggtgaacgtggcgtagagtggaaagagttccttcagcaggtgcggtctatctcccgtggcgacttgtggcgtcacaatcaagctggtgatctagtaggtcaggatgacgttatcgacggcgttgcgctaatggatttggtgaaagccaacaaaggacgtcgcggcttcacctacacacattacccgatgaacaatttcatgaaccgccagcacgtattgtcggccaatcgtagcggcttcactatcaacctgtcgggcaacaatgtagcgcacgccgatgaactggccgacctgaacatcgcccctgtagtgactattctcccgatggacgcggagaatgtaagcttcacgccgaaagggcgtaaagtggtagcttgcccggctgagaaaagcgacaaggtgaattgtaagtcgtgcggcttgtgccaagtggccgacagggagtatattatcggcttccgtgcccacggcacagcaaagaaaactgtcgatctcattgctaagggttaacacaatggacgaatctgtttacgcaccattcaatcagtgtaagatgatgggcctagaacgaaccgtgcggagcctagcggctcctaacgggtgcaaggtagtcttgtatcaggaccataagaacaagcatagaatcgtcatatacgatgccttagggcatggaatgtctggggtcatggtgcaagcggatggggaaattcactacaaggaaacccgcaaggctagccaagggcaaaacctgacaaggcaactacaagcccaactgaccgcatggggagtgaagtggtttccctctcagtatcagacaacggcaggcgcagcttgctacaaaggagaccggtaatgcgacagcttaacaaaactcaattcaaagcattaggcgctaagatcgacctagccttagagctagccgctactggtcgaggtgaactaatgaatggctacggctctacctgctacatttcaaacaaggctggccataatatccttcgagtgagctaccataactcccgattcgttgtgtacggtaacgagagcgtccgggttaccgggaccgccttgcaggcttggacggagtggaaaggcattaatctggcagccatcgcgtctgttagtgagtatgggtatcatcctaacctgagcatcggtcacaatgacgctcttaagactctcaaggctattgagagctaccaacgggagcccgtccagtgacggcctcctactccgtagacaagcggggacagcgctgggctgttatccgaacggaactcagctttcgaggtgaaagagtcaccgtgatggggttttgtgtagaccgggcccatgctctgaaaacggtagccaaattcaaagcttggcaagcgcaaggctggccctacactctgaaagacgacagaaaataaagcttgacagcttaggccattcgcgtagaatggccctcaagcaagacaaaccagccatcaggaggctagaaaaatgaaagctgtagctcagttcaaaagtgaagattacgcaagcggtgatagccgcaccgctaccgtctatgaagacgtctatggctgctacatcgtgagcgttttcggaactagcttgagcgagcccattgccttccattggggcccgttcgaggataaagaatccgcaatcgatggcgctaagtctgctatctaataaaaagggactacagaatgaaaatctccgctatcctgaaaaataaccttgaactttacggaccgatgactttcatgtgcaatttgatagaagatgatccgatcctaggggaagaggaggtaatcgaggctaagcggtttatcgaaagcctgctaggtgaacacttcactcttcacgctaagcttaagagtgaattgcgagaatatgacgcttactatcgcggcgacgccggtttcgggtctaaccgatgctttcaaatgcggcaattgtggtggaatactgtaatcgaacaattggaggctcaagggaaatgacgcaagctaattggtgcaaaggagtccgcatacttggcgggaagcgggacggcgagaccgtcctgtttaccgacgctcacttcagcgagtcgatgggtatggcaggcggcgaccctgaactggtggaagctctgcccatgcctgcggcgcttcgtttgctggtcaaatggaacaaactgtgccgacaaatgaagcttgactaccgctacgaactgctgtaggctacagtctcaatcagaacaggaatgaaccaatgtcgattctagctctaaccctaaccctttgctctgctgtccagtgtgacgactacattatcgatcacgcgctcccgggacaagccgcagagtgcaatgctcggctggtggaggaggccgaggagtggggcgatgcgtgggtggcgaccaatgctgacgcccggctgacccgataccttagccgattcaatattcaggttgacccgcgctttgttttcgactacgattttacctgccaactgatcgcagaggatgaactaccatgatcgctccgcatatcaccaacaaacaataccgtagccgtgccgccgtcatcatccgtcgagtgaaatactatgaaagccgctggcttcgtactgtagagtttttctcaggcgcggccgctcagaacatcgcagaacgctttgcctacgctgggcatgccgaagagcaactgtccaaacttaaatccgagtttgcagccttcccggtggaggtgaggctagatgctctaggttggataaactggaatactcataacgacggtctgctagaggagtggattcatcaggatagtgaccgtgccatcatgctagagtatgatagcgaatcgaagcggcctgtagcctgctgggaaaccactgtcgatgctcttcccaagctggcaatgctgtaaaatattgcccgtcaggctgaaataatgcttgacgggcgtttttgtacctgtagaataggcctcaagaaaggaaaacagccgaaaggctcaatctgaaacccggagatcaataaaatgctgctagttcatgggaccactgcaaaaggcctgaaagctatcatgaaccgtcaaggcaaggagggattggccgcaccttgggacgtttcggatcatgacggaatgtcatacttctacaacgtgaacaaggctatggaatggcacgatgaagaagagtatgctaaagcggaatgcattatccgttgcctagaacaggctcaattacagcaagctatgatggccgaaggcggtaaaatctacgctctggttgtcgatatccccgaagagtttcaggaccgcgtagaagatgattattcgtgccctaacgccagtaatgaagctagctgttttccagaggataactttgatccatcatggattgtagaagtgtatgaggcagaggtgagtgtatgggccatccctttcatcgtagctggagtctcaggtaattctatgttccaatcccaccaactacctgacaaactggtggcgatagcgaagtcggtggcgcagtccagtgacatagacacatacgaagctttcgagatcgaccattcacagctcccgctgtcaattctcgaacatttcaaagataacgcttgacagtctagccaactagcgtagaatgcctagccaaggggtgcataagcgccccattcaaaaggatacagaaaatggccatcgttgatcgaaccgcaggtaatgaaagcccgaatcactgctacatcgtcactggcagcattggaccagagtttgagccgactctgttcactacccatgcgctggcaaagaagtatgctgagcagatagtgaaatacggcaaggcaaatgatgttttcccgccttttacgcctgttatcgagacccggcacaaggcagatatgaatcggttcactgttcacaacaaaatcccggaataggagataaatcgttgaaactctctcaaattttccaagaaggcctcgactacgctatctttcacggaacgccgtggtatatgtgtgtacgtctccgggaactggacttgccaattaatctcgacgacgtgacccgggacattcgatctatcatgaatgaagccggaatgacccggcagtttatcggcgacagttgggatggcggcgtggacgaccacttttgggaaactggcatggctgatgcttatgtgatgacgtggcaagagactatcgattacgggagccccgcctatgcaatgtgggtgcaattttggttcttcgtaatctttgacttagcccgaaaagggcagtagaatagccggcagataatgtgatctaagggacgatcatgaaagacaagactgtagtttatcgaatcgagtgtaataacggcgagggcccttatgttaatgggtgcatgacgaattcgtcttccactccagaacggcctgtccctgagcacgacgggataccggatgttcgcgattttgagttcttcgccttcacgtcccctaggcagctagacgattggtttggcgacgaatacgatgtactatctttctattctaccgcacggatcagggtctatgaggtggacaagcaacatgtaagggtaggcatccggcaatgtgtattccgcaaggcggaagctgattgcgtccaagaggtgagcatagaccaatgggttagcatggtgaaggctggaatgctttctgccgtcgtcgcacaagctctatctccggtcccgcctgagcagctatccctagacctagagggcgatccgtcctgcacagcttcgaaaaaaaattttgaaaatgttcggtttatagggttgacagcttgagtcattcgcgtagaatggccctcaagcaagacaaaccgccggcaggcaaaaccacaaacccggagactcaccatgaacaagccaatgaacactttcgcatacgctcacttcgtagcacgtcaagacaaagctagcggcaccagcctgccctacgcaacgctgtttcgaatcgcccttcggatggcctatcgccagcccggcgtccggcagtatgactactcctcccttgtcgaggatatcaagcgccgcgaactgatccaaaagcgcattcgtgctgaaaaggctgtagttatggccgctgttatgcgtgcaatccgtactggcttcactgttagcgtgaaagatggcagcgatggcgagtgggtagtgaaaaagtctaccgatatcaaggaaatctccgacagcctgcaatctaccgacgaggatatcatccgcttccgcaagggcgacggcccggacaacatcgtcggctctatgtgggcaatctacggtaacagcgccggcgaagtgatcgccgactggaccgaaaatgccaccatggccatgattatggctcccgcagaacgtaagatggaaaaatacgctgaaattgggatttaatgcttgacggggcccgaaaagggccccataatgcacccataccaaccaagcaatcctagagggcaacaccatggctacactgattatcggcaacgtaaactaccataaccatcgtctagtcgatgaaatcgctggcgatgctggctacaagggtgccgcccgcttggtggacgaatgcactcgcaaaatcaccttgctagcgccttctggaatttctgccatcgacgccaaggagcgtgctgaagtcgccgcaatgattggtgagtatcttctggcaggattcgaagtttcgattcagcactaacaccttaaacccggagtactgacaatgaaacgccaatataccgactcttaccagtgcaaagcaatcgacggcatgatctctatcctcggcagcaagaaagttaccactcaagtgccgccgtcgatgaaagcctctcgaaataaactgctgaaaaagatgataaaatacgtcgcccgggcaggatggaaaccgtaatcgactaattatcacagccccggcaagccggggctcacaataggagataaaagcatgaataccctgattatccgtttggattccgcctacagcgttcaaactgtccgtagtttccttatggaagctgtagagagtattcgaaagcatatccgggactacgcggttcatgacgaatacgattcgggattgagcccggtagcacccaatcatcgacttgcaatcgtcaccttagacgaagattgccgagtgtttcacattcaatgcgagtcacctgatctttatctggcgaaccctcggatcgtgtttactgatgttgaaagcccggcatataccactcccgtgaacgagatcgaagagtatagttacatgaccgcatggcagcatatacgccaaaaagatatgacagcaaaagactacctgtcggattggtctatccttttcgcctcaaaggagaatgccattgatatcgacccgcgccccaatctgaaaacgcaaatcttgcattaactgagggagctaggatgaagcttcgaaccatattcgaaacctacgattgccgagttaggtttgtcaccataaccggcgtgtttgtggaatctcaaattgtgcggagtttcggtcaagctcaggagattgtatcactcctctgcaatcccgcagatactggtatccgtctatccttcttcgacgaagaggagggctgcgagtcgatcctctgccgattcaactacaaaggagaaatcatcaaatgaataacaagtataaggataacatcattgcggaatactgccatttcgacggcagacggccagtcctttccttggcggcacgatgggtccaccacgacagtcgcgttgtgaagctggcagcgctctttgcctgtgctggctatggccgtccttacaaggactgtattggtgcctacaaggctgctaagcggcgggaaaaggatatgcgagaccccgccaaatggaagcttcagcgggaagccaaacgagctgtgcagtggctaaaagctaccatgaacaaacgcaaataaggcagaaatacctgttgacgtgagactaaagggttcctatactgtgcccatcgagacgcacaaagcgtctcctaagctagagggactagcaaaatggcaaaggcaaatctgaagttctcccgcattggcaatgacggctacgactacgcccgcagggaagacggggtttggtttgtcagggaagggtactacgggcggtacggctgggctaaaaccaaatggactcaagttcaacccggagatggcatgactatagttaacgcctgcctgaaggctcacgaagctggaagctccagcacatacatcggattcgggaatctggtggtattctccgacgggaaggggctccgtttaccctgaacaggaactcaaataaagttgttgacagcttaggccattcctgtagaatggccctcaagcaaagggaatcaccctgagcaactgaataggtaaaagacgatgcaagcaacctaccaagccctgaaaactctgcgcgatgcttgtgaagctgtcaaggatgaaaaaggcaccatcaacggaaacaaattgaatgcactgcgtaacaaggctgtcaaggaaatgcaagctggcggtgaaacctactctgacgccattagcatggctcacgacttgattaagaagtatcgcaagtaaccataaccccggttcgccgggtcatcacagagcatgaccgaggagacaacatgaataactcgcctgtagttgtatgtcttaagtgcggagccgtaaatggcggacagagcaaacacaatgttgtagtagctctggggaagaagtggtgcggtcattgtgggtccaatctcgcaacccttcgtcgctaaccattcactgagacctaatcgaggagagatcatgaacgccactctggcacgcctacagaacgaacgctgtgcaaccctccgcctgatgctgctgccggaacatcgtggataccagttcactggccatccttgggccgagcgaatccgcaatctccacgatgaagcccggtgcatccgcagccatcactaaaccgcactaatccattaaagctctaacagcccgccctgtgcgggctttgttctatctgcgaaagcgacagctttcaagtgtaattaacatgtaatgttgtaacaccctgtagagggtaacaccagcatgacaagatagaccacttgtaacgttaacgttacatgtataacagcatgacagcggaagctgtatgttcacattctgtatagataaccctatcaaataaccccacaataacctacctaaaacctaccggtttaaagcggcctgataggccgtagatgaagcgatagcttcgctatgttagtctgcaccgtcaaggcgaaagccttacagcatgaggcttgtaggaggttttagaggcatatgcgattagcataggatgttggttgttttgagtagattttgggtataacccctttccgcgctaccattgtctcagtgatgttaagcgacagcttacatccgctctcattttgcaatgagaattgcgtacagttcatcatgcgcctcagaagtgacttcactttgcatgcggatgcatgctatagtataccctgtgatagctccgctatcccgttttgcatggcacacgaattgcataagcatgacaagggtaaccctcgaaagcggagctttcaaagggtagagactaccctttagtatattgcgaccggaagtagtgacactgaaaaccttgactctagcccagtaaatacgttaaactaaaaggttgatagctgccgctatcgagtaaccaacattcacacaaggaggcacaatgacaagcaacaatcatgccaagattcacatccattacgctaagcaaatctactacgccatgcgtaaacgtgccatcgcaagcgatgagctatgcaaggaatgggccaagcccaagacaggctttgaagcgttctatgattgggtggtgaatgtgtcagggtacgccgtaggctaccgcctagacaggaatattctcttcccgggaaacaagctctatgctccgcatacgtgcgagttcacacctacatacatgcatacactcttcaccaactgcgacaagacaagcaataaccgtgccaatacatgggatagctatatccctctaggcgtccgcctagcacgctatgacaagtacgggatgcctgtatacgttgctcagtgtaggacgcttggaaagcagtctacccttggatcgttcgacgatccgatgcaagcccatgcggcatggcaacatgccaaggtagcagccatcctcgaatgtattgatctctatcagatggaggatgttcacagtgtgaacgttgttcaagcgttgcttgagagagtggacaaacttggcaaggatattgcacaggggaaagagactacattgttgcagtagatcgacggggccatggtcaacccctcttagagtgcgagtaatccgatagcgaagctatcaaatgtatatgcatattccatgccaacatgtggaaagatttcacccggcagggcgggagcccgttggcattagttttgcatagcttagctgtcgctaagaaggaaagaccacggccacccattattttgaatttactaagagttaggg

SEQ ID NO: 10 - DNA, 92604 bp, Myoviridae Pakpunavirus
  misc_feature (1)..(92604)
gcttacatccgctctcattttgcaatgagaattgcgtacagttcatcatgcgcctcagaagtgacttcactttgcatgcggatgcatgctatagtataccctgtgatagctccgctatcccgttttgcatggcacacgatttgcataagcatgacaagggtcaccctcgaaagcgaagctttcaaagtgtaggctctaccctttattataattgcgactcaatttcgcgacaccagaaaacttgactcaagcccagtaaatacgttagactaaaagatggatagctgccgctatcaatagatcaaaattcacacaaggaggcccaatgacaagcaacattcatgccaataatgcccgctcgcctatcggcgaagaaatgcacatccattacgccaaaggcgtattccatgccatgcgacagcgatgcaatcccaaagaccgaatctataccggggcttcgctctgcgaagagtggtctaagcctagagcagccggattcgaatcgttctatgaatgggcggtctatgaggctggttactcagaaggctaccaactggacaaggacattctattcccgggaaacaatttgtatgctccgcatacgtgtgcgttcattccgcagtacatgaacaaactcttcacaaactgcggtagcactaagcgagtcaatgcaaaacccaagccagctaggacactcccgctaggcgtgcagataaactactacagaaagaacgggaatccatcctacacttcacaatgccgatcccttggcaagcaggcaacactaggttcgttccgaaccgcaatggaggcacacgttgcttggcaacatgccaagatagcagccatccatgaatgtatcgatctctatcagatggaagacgttcacagtgtggatatcatccaagccttgcttggaagggtagaccaattgtggaaggatattgatgcgggcagggagaccattttgttgcagtagcatctcgcctagcgtctcgacgcagtagtctcccatgggccagcggatacccgtctgacagtgcgagtaatccgatagcgaagctatcaaacgtatatgcatattccatgccaacatgtggaaagatttcacccggcagggcgggagcccgttggcattagttttgcatagcttagctgtcgctaagaaggaaagaccacggccacccattattttggatttactaagggttagggtagcgaggtgggttcgtggttaagtagctcggaaataaatccataactggcagaaggcgaaccagcagagggcaggccagctccctccattattttcccagcagtagaggagacacactctacaaacgtatcactctcttcggcgggggtttaggattcgaatatacctttagcggctaaatgccatcattgcttatttcctattttcgtgctataatccttataggatgtgcttattcttcattatagctggataagcgatggttgtatagattcaccacaaatagaaggaatatagaatggaagataatattcaagctccgcttgcagctagtgcagatggcaaattcgcaactgtatacgaagctattgtcgcactcggagtagaagggggctgccgctgtgtacagggtaggtgtagggaatagattgacaacagctagaccataagcgtggtaaagagaagccccgggcagcgaaagctgatcccggggcttttttattgccttgagtttatgtatgaagagattccagttgtctctgctcttccatatactccctagtggcgtagttcatcatgaggttgcaatactcttcgtttatctggtccatgtattgcaacactttctccatgctctggcacggactgaatccgttatgacggagaatcttgtttagattttcacttccccagaagtctctggcccaagcctccaaagctactgcgtagaggcttttgatgcacccgataggggctggataccaatattgctcagacattagaccctcccgaacgttacgatcacgccttgcttggctagggttgcttgtagctcatccagtgagaggggcttaccgcccacgatgacatacttatctgcctctcctagagtcatcacacacttagtctggaaggtaggcctatacaaggcgtacatatcgggttgccacttgcttcgcaggcctgttccgtagctaatgaaccggtcttcggaatgatcccggatgtacaggcaccggggactatcatctggcccatctacggagatagggtgttccatccactccctgatcttatcaacgacgccctctcctaccttcaattgagcgtactgacagtactcaaggaacgcatcaaactgttcggcagtgaaattgctgacatcgatctctttagttttcattctcttcctccatttctgcaatgatttccttcagagcctgaagagtgtaagtgccatttagctctgtagtagggccagtgtcacactcatgaagtgtgtacgcggtcactttcttctcagtgacgaaatggaagtctacccttcggaagtcgtaggtcgatttcgagtatccaatggcctctttgagttcttcctcgtaccacaggaatgtcattggacttccgtcgcttttacgagtgtagtccagcagattatcgccaacccacagtagcacttgagccttgtcgtacatgaagccgtttccgctcccaaactcgataccataagccttaaggtgctgttgtactgcgatgttctcttcgggggtcttcacaatagtgtaaaacttcaccaaacgctctttcaatttcattcctcctgtctgtgttttatgggagtgtaaaacgttcccagtccattgtcaagctctctgtgggatagaccgttccagacgctctctagcctcttttagaatgatatcccactcatcgccttcttggactcctacatacttctccatcatcaacgcacggtcaatcagaccagccttgtagttatcccggctacgcttgcgggctaccagcttgtcgatgtagtccttcttatctgccaaagcggcgatagccttcctagccataagggcagcgtattctttttcctccgaagtcatccacggcatattggtcagtacgaggtcagcggcgtccctgaccaaggggatatctctccataggaatcctaccggtctcaggtctgagtctgcggtagctctccactgtagcactgttccggtcttagaatctgtaatatgcaccttctcatcgatacggtgggccatcatcgaaaatctccagttgcggtctacgatccatcgcttccagtcgaagaatgtagcacaaatagccttaaccgggtctccgaccttagcatccagttccttcagacgtttaatctgcttagcgtttatatactttacaggccgggaggctggatcatagcactcctctacctgaaactcctcagcccgagactccaacactttaggctcatcgttactttcttcctctcggaaccatgcgaacagcttcttaaacatattcagtcctcctctcctgtgatagctaccctagtcagtctccacacttttctagggagactaacgagaaatagcatagccataaacggtacggcgataggccagaatattccagctaacaccgctcgggcctctttcttacgcctctccgtactttctcccctccacccaagaaggggtcgtagagattcccatacgaacatccctatcacagagtagaacaataggcagaccactccgacgactatgcatactagaattagaagccctacttgttccatggtgcgatcctcttaagtagtttacggctgttccagatagacagagcccacttaggtaacaacaccactttcaaaacgctgtatgttgcgtagagtagcagaaagctagcatacactgtgaatgtaataggccatagcagtcccagtacaatggcaaaagcctcgataccctctctgtgatctttagtcgcactagctgggaagttatctttgaaatactccgtgatacccatgtaggtccacatgaacacaattccccacgcgagcgcgaggacgaatagcattgggattatctccattactcccctccttttcgaatcaagtcgaagtaggcccacacgtagaagttgcaccacgctctgcctatggcccagccttcccaatagtcttcccagtccttgttcggagggttattctcgaacatggataacacgcatgaatcagctacttcgtccaagaggtgcattaccgaattaagcggcccgattccaaaggtcttatctagccaccccttaaatcgtcccacgtctgagacggtgacgctggagtcactgcacagtgccaatctctccagaatgtagcacatgtaaggctcttcttcgttctctaagaatgcccgcatgccctccttgattagcggtgcaatagaattagagttcattgttttcctcctttcgaatcaggtcgaaataagaccagacataaaagttcacccagtttagatcagtatctagcaggtaattacgatgaagaagagagataactgaatcccacgacggaatcccatgctcctctagtagccactctctgaatgaccgatactctccgtgggagatttgcccttcttctgctaggtcgcttagaatataacacatatacgtgtcccggccgtttaccaagtaatcttccagtcccatctttatcaactctgcaactgatctcattgtttcctcctctgagagccccactagggctcgaaatttttgcttcgacctccggtcaacacattacaacccagttgtacaggtcggcctcctcataagctgatgggtagcgattgtactccaagaagaacgcgtggtcaatagctgagtatttggttgcgaaactcgtaatgtaagtcagaaacccgttgtcctctttcctgaacaggacgtattcttcagtaccgtccttaaacgtatctagcgagatagtatacttatcgaagatcacagcatttcctcccggctaatgtagtagttgtagtcgtcctcttggacgaggaacgcacgatagaagcctttctcaaagtctcccttgaccagcaccagattgccctccaccttgcatgtatagatatacatggtgtttgctactcggataacaggatcatccccgggacgaacatccagagcagagagcatagcctccattggcatgcttgtcaagtgtgcaactacagccgagcagtattctgcatcgcggccagaagtgtcctctgcataagcaggagcgaccccgcacgaatgcagggcgagtgtaaacgcaatagctacgagtttcttgaacatactaaccctcctcttggtctgtctggggaacatccggcttggggtagacgaatgtctctggatacttcatgcatcttagctcatctttgcagaacccgtcaatcaatttctcatgtgcgaattccgcagccttgtagtagcgattagcctgtcttgcctccactcgaaggaggtggcttatcgtgtgagcgttgatattactaagacttgcaaaaattgtcaagagcttctttgcagaaagagggatcgacctttcgtcgggtctgtaccaatccagccgggcaactccttggagaacgtcgtccacccacagagggtagtctccatcaagctcgaccatgacttcgtacatttcaggctgaacagcgttgaaaaagaaagagggctttcgccctctgctggtatcaagaggaggaacaagccccctctctaccttgtgaatcaaccggtcagcgttagaccctatacgggcttttagctcttcgatttcttcacatgtcaacatacggagggcacaccttagatttctcgatagtgaacacgccttcgcatgtcaggttagcaggtccataccacttgaacatgttgttgatatcgtatcggatcagttgcctgaacttctgaccgtcacacatatctgcgtcgaaccaagcaatagcccatctaacgtgctcttcagggtcgttctcttctcgccatctgcactctagatcaacgtgactgggctctagaacgtaaatgtcttcgaaccctgtactctggttgttcttaagtcggatgattcgagcgcgaatccattgcatgcacctgcggtttgggtctgtgatatcgcagactaccggaacctctggaacctcaactgtatacatgattgtacctctatttgttttacaagaacgccatgattctatctctgtctgcatggcggtacagattgaagcaaggcacacctctggaggatgccagttgccaagcggtcctagtcccgccttctggaatcccattgtggtctgtcttgctccagcacaccaagaacttgctaggcgtgttgagatcgattcccaacacttggaaaacgttccgagtgtgggctcgtcttgcgaacgggcttagaacgggtttcccgtcatttctgacagaattccaagctgggtggatttgactggcaatgtttctagcttcttcccattcgtcctgcaactcttcctctggcaggatggtagctccaagcgtctccgttatctggtactggttgaagccgggagacggaagatagatttctgccgtagttcctcccttgttattggatatataatccagccagcccgattcgaacgctgagtccgctcccttcgctcctcctgaccgaagaataaaaccttgttctgccagtttacggcctacctctcgaaggatgccccattctctgttcggagtgtccctgcttccgactcctgtataatatctcatcgtctcaccatttgtcccagttctccgtatgtaatccagtggtgacgataatccccttcttggttggtgtactccactaacaccggatagaagttgtctgcgtggtctatgtttaccaccttgcattcacatcctctgggaatagtgtatccatcgctgctcatggttaagagcattccccggtacacgtcttttatctctagctcaccttctccagactcttcaaacttgagtctcaatttctcgattatttgagcttgcaaatagagaagttcgtacgctgttaggttgtccagatcaatagacatgtcactctctcccttctagtttcttgaatgccttgtccagcttggctagatgcttatccaacttgtctagctttttatcctgataaagctggaacgcctccgagcccggggccaaccaagtccccttatacttaattgcaccccggatcatatctcctcctattacagttcgtaaacgtacacttgaaactggcccagtgtctcctcgataagaggctctacattgctccaatcttcacccgctagcccgcagccaatcttcggcagacccacgcacaactccgaggtaggaatcgcccgtgcatcagcctctgcctctaagaacaaagacatagtgtacaaggcttggcccagtgcgtcaagctgagtgtagattcgcccctcttctcgcccgtagttgtactggccgtacaagttgtagatggagccatactcgttcatcgtgaaggtgagggagccgagctttgctcggtcccctttctccgtagctaggtccgcctcgtaagcttccgggaattgctcccggatttgcttggcaatgccgctgcccatggtgttgaagcaattagcctgatgcgcaatagcgtgcaactctttgtttttgaacgctgcgataagatcgccctttcggtatttaatcatttgaacctctctacacttgtgtatctgatattcaaaccttccgcatcagctctgatcttatcgtacatcgagtctaatgctgcgaatggagaccagtaccctttctcccagattttaaacttgaacaatctatgtcctttattctctggcctaccttgctcacagaaggttgtaaaataatatttagccaacatcctcgcctccttacacgccgttcttaatccgataacggatggattccagatcattattcttcaaatcttccacatcccactttccatccttgaagaacgtccgcagatgcccggtagcttcttcttctttagatacgccatcttcaagtcgcaggaatcgtccattcccttggtctcggtacactttcaagagacctttagccgacttcttcttgctgtcggtcttcgggtctttgaagattgcaatgccttctccgttcacctcggtgtaggtggccttcactgcgaacccgaaggtgtctcgggtattgcactgataggtgtaactcccaactccgaagaccacgttcaaggatgcgaaacctttctccttgagccgctccaagattttggctgcccgacgtgtggtgatcgaatccccatagatcaaaccgatatgagaatccagcatcttataaccagcttcgtttacagtaccaccgaaggtttcccaaagaacttggatagcgcctttcacctgagcctcgctaacttcctctagtttatagccaactacatactcgtactggtcccactcggttggaatgaccttgaaatatttatcttcgaactctagaacaaaagcgtcatttccgttgaccgcatccatgatatcccagtgctcaagagattcaacaacttccacatcgcccagtccgcagataacctctacaggatcgccagaatcgggacgaacaaccagcttgccgtcacgttccatgatctgatccttgatggacggcagaatgtcagtaatcacgccccagaagtcgaagctgtctgccacgtaagacagaataccactcgggaacttacccatcagttcaacaaggaatcgacgttctgcttcctcacggccacctttaccttctccatccttcatttctttctcaatgcggaggatgttactagtagctacagcgtgttcagtcgcaggaacggagcaagctaccaaaccagtcgcgttatagtagtcctcagcataaatagctgctgccaatgtgtccgaacctacgaacgaggtcaagtgaccgacaccactacgggctgcgtcttcgatcccgctcatgccccgggcactgaagtcgtggaactgaacagacagcaggaagtcgtcatagcatccagtgtgattcgcgtagtatcggcccatagctgcgtattctgcggcgatagtggcgttagtcgcggtcttccaagtcatagcagaaatcagtgtttcgtggtagttcactagccagtagaactccggcagggtgttcttgatggtgagaacaggcacgcccatcggtacactgacgccttcagtcagagatttaacctccagaggcagataaccgagcttgtggagggcacgaagctgctctacagcctccatctcacggccaaagtaaccagtcaggaaccgggcataccggccaactgcgttctcttcgtcagccttgaagaagccttcccaagactcgacgatctccatccaagcagcccgcccgccgacccacttaagagtgccgtcgtagaagtcggtggcgtgagtcttacgataaattttgtcggaacgaggagtcaggttgctgtagacgagctgagttccttccgagtacatcgagccgtgcccaatcttatagccatcggtggacaggtgtggcagaattttcatattatttcctcctgttgtgttgaatgggcccagattatatcaatctgggccttatgtcaatactcaatttcttctactggtagtatcagtacagggtagacgcatggaagacgcagtaatggttgcttcttgctatgaaagtcttcccagaacttctcatgcaacaccttgtacctagcgtccagttcttccttggtatcgaactcctctaccttgacaaccctcttctctggagacgagcgcttatactccacaatccatatactcaagctcatagcttctcagccctagagtattcgacaggaacaaccattagctccgggtggttctcttgagggagagtatcagatgtatatatgcacccgaagtcgtccagtagacaatcaacacccttgctgaagattccgtgggtaacgaacagatcaggcaacacttcactgtaccctcttagagctttagctacgctacggaatgtagcgcctccgtcgcagatatcatctagaacgagcagcggcaagtccgggtcaatgtcagagggatttagaatttcaaagccctcgatcttaccagtctgaaggtctcgcttcttattgcagcggatgattactccggctccggtttcctttgcaaattgttcagtccttttagtagctccgatatctggagctacaagctggtactgttcccaatccgaccgatccagcagtccaccgaatacagacgcctgagacacaacctctacattgttgatcaggtgaagagtagcctcactgtgagggtccacaacgataacccgatcatacccagccgagttgatcagattggcgaacactttcagactaaatgcgtccccgggattgcatcgacggtcttgtcgggcatacgggacatagcccaaaagaagagtcatatgcggtcggcccattgcagctcgaatagcctcagtgacattgagaagtgccatgatatcgtcgctgttctgaatctgagctttaacgttcacaaaagaccctacactggcatcaattccacttacattgacacctacctcaccacccgggaatgtccagacctttgcctccttcataggaagtgcaaaacccggttcctcaatagtagcaaggcaacctgttacgtagctaatcatatatcctcctttacagcttcacagagaagcgattccgcattgcttccatggaactctcaggcacatcgtgtaccgatttattgccatgacggttctctacaatcagagatataacagtgtatccaaactcttcggccatgtcaatgtaaggcttgatctcccgttcccgagtcccggtgttggatacgatcactgcatcatacttaaccacctccattgcctctctggcacgctccatgcacttcctgtgtgcccctgccacgcgctcaggcctccatacatactctccttcttccatcaggaagtggtctgcttcgcagattacagcgttgcccccggcggcccaagtcctatcgtttagaattcgggcgaggttggacttcccggagcccgggagtcctcgaatgatgtacatgatcttttccttcatattctctcctttagattcgagccatatcgaagtaggtttcgatcagaagccgacgctgtgcgtcagtcatttctgtaaaccgaacctcgtccacttgatttaccaagaagtctaccagagggtagaactcttcgtcaagcgtctgcttgaaccctgccgggtcttggtacatcgcattgaccttcttgctacccatccgcatgataaacttcttgcctaggtagtgagtggacttgcacttcaccgtccccatgccggtcctcaccatgtaaccctctttctcgcaggaactcagcaaacccttggcgtgctcccaactacactcgatatgctctgggcggagaatcttgacacagcttccagccgacatgccatgtgcatatgcatctagaatattctccgattgctgctccccagtgaaaatgtcccttacgccaatcaagtacgcgccctcttcctcttccacaatgtgagggtcttccggcgagcagatttcaaagttgtacgtaaaccctgcgatgtagtcatctggattctcagacacatacttccgaccaagtgcaacatagtcactagtcagcgatccggtggtgctgaagattagcgatccgttgtgcttagttacagagaacatgaatccattcactttctcaatcaggcgaacacggaatttaggatggaggaaacgacccgctccattctcccctaggttgaacaccttctcaaagggacgaacaatacaatcaccggactgttggtcaaacacgtgtccccgcgcttcgagaagaagcgggtgctcgttccacaggttgtcgtagaataccttacgagcgtatttaataaccgacataccgttgaaatgcttaaccgtcactagctttttgtcgatcaggtctttgtacatctcaatacggagtttaccttccatcctattcctccttattctacttctacaatcgggcagaatttagacttcttcgctttcaaatacgacaagaaaatcccatcctttttatcgggcctcttagacatcagtcgagcgagccgatagaagaccgatacaccgtagaatacagccgctacggtaatccatataaaccccataatagccaaagtcccgcctagaatgtagccggtcgcgggtccaagtagcagtgcatacaggctggagcctataaccgatgcaaatgctactgaagtgagggctagccacactacaagaaagaccgtttgccagaaataagagcagagagtaacgctcttccatccgctggaaatgtccaagtaggtaggactttcgaatttacgatgcaggcgcatatgccacgaattcttattaatcttcatgcttgttcctccgggaagatgttgaaattgagtacgttgtgctcttcgagttcgaaagaagctaccatcttgtagcctccgagcttgtcaacgatctccagtatactctcgatagagaatttgtcaacatgctgcttcatcagattagagattcgactctgatgagtaccacatctctcagctacttcccgctgagtgaggcccgactgagaaatatagtgtgcagccaccaccataacagcctttttgaaatcttgaaccgaattgctcatgttaaccctccttattactcagtgtaatttttccgctaaatactcggaactggctgatctcgaactggtcagtccagcgagcgtcttcgaaagccactccttcgaaagttccatcaaacttgacgtctgaagtcatcagtacaatgaaaggcacgccttcatcgtggatcagctctacaagagtattagccttgggtgtaataccgttttcttcacgtgaaatcaacacattaaccatattatcctctctgtccgtcatggtgatctactaccacaaattcctgattgcgcatatattccctcacttcgtcgtaagagaatacctgatgatctgggtgattgtcaatacctacatcaaggcgcttacccttggaaggcaggctgccgtgagtgtggccgtggagatgccaagcgccatgatgggcagtattccacgtctcgaaaggatagtggcacatgacgatcttaactccgtcaattcgaatctccttgtactcacgaatgtcttctacgtgagagagattgctatcagcgatcaacttccacagacgagagtcacagtggtttcctttcaagaaggtgatgcggccattcaactgcttgataatatccagtactgattgcagcttgttctttcctgcaaatgcgaagtcccctagatggtacacttcgtcaaaaaggcctacccgggagttccaccgagaaataagctcctcggtttgctcctcaaaagtccacggcctgttacagtattcgatcacgttcttatggaagaagtggagatcggaagagaaaaatacagacattatgcctccttttcaaattcataaatcttgttgatcctgcggatcagtcgaatagcggcccctcccagcagatgttcacgctccggctccatactagccatagccttgaactctgataacatatcccgacgctcgtagtggaaatctactacccagtaatggtccgcactaatcttaccctctcggtacagatgcccttcgacacccagccagcgatccactgcatctctcttcagtagctctttcggagaccacttgtctacaccccgcaacttctcgaagaaagagtaaggacgagaatagttgttgatggcttcctctacagccgactcagcctgcaatttaatgaactcccatcttgcaagaacttctttaatctcctcggtggtgaccggggtgtagctgtactgttctttatattcattccacactgtactgttctcctacatagcctttgaatttgtcggaacgagttgtcttcttccgtggcttgttttccagaactgatgcctccctttcgagcatgctcagttggttgctatacttcttgatccgcttcgagttaccactcatcacagaatttgtaagatttgcgatagtatcgcaaattttcacttctcttgcaaccggatgattacggcaagcttcgatatacttacggtagctctcagcacggttcttatcgagaatgaccaaagcctctacgatgtgaggcatcacgcccatggactccaagtcttcctctgtcaactctgtatcctccagaacgtcgtgcaggaagcacacagcgagaagagtgtccatgtacggaaggtcggagaaagcctgacccgggtccatatctttaggagcgttgcgggccacgcagactgtatgcacctgattcagatggtaagcatacgggaagttggtctctccgtaccgctgaccttcgtgagccgagagtgcgatctcaatagcgataccaagctgagtgttcatattagtctcctttgtagaatgtgtggttgcctatcttgattgtgcgcttgtatttcctagcccaccgaggaagcttgccattattagcccgtctcaccttcctctcgttgaggtagtgatcggctcctctcgttggatcgacagtatacccatatagggcgttgtatgcaacatgtttcgctgcctcccacttgtcaagctccttgacaccttgccgcatactcccatcgcaggtgtaggaatactggcacttgaagtagagcactccggctactgtgctcggccacctgtcgtgcttcattctgttcactacggtatgagctacagcaatctgaccgatctccggttctccccgggcctcgaagtatacagcttcagccaacaacctgcaaggctttctgtactcacacaaggtgcgcttgctttctatgatttgaccgggactggcttggaattccactacaggctccgtgccgtattttagacgagagtattccatgtcgaggaacatcccaatgaaggctagaaggatcgacaaaacgagagcttctaaggtttccataacacctccttagacaaagaagcccgccttgtgggcgggctgtatatcactcggctattatacttcagcccaagttgtaacgacgggcgtagtctttgttggggaactcgaccatcatcgactgaatgtgaatgttgcctttacgatccttctggattttggcatttttcacaatcttactagcctgcgccttagccataagctcagggctcacaaccagatcgatgaaccctgcacttcgatacccacacccggctggggcccagaagccatgctgggtcatcgtcgagataggtacaaggtacagattgtgcagccgcaccgcagtgttgaaactcagcttactgatgtgcttcgctccccgggtttcagtttcaaaacacccagtcatgtaattgaatttgtaagtgagagcatccatgaactgaatgacacttcgaatctggatagcagaagtatccaagagctggaactcctcagcggcgtcgattgcagtggtcacattgacagacttagcattgaacattttatatcctccttattcttcagggacaaatacaccgccgattacccggccagcgcgaattagtttaccagttgggaactgagcacgcaaggtctttttgaaacgactttgaatttgcacagtcagccacttaccccggtagttctcaaaattagtgatctggtctttacgggcttcaaagtcgccatacgtcacctcaagcatctcttgaggtacagggtcgaacaccaccagaacagcgtttccattcttgtcaaccacgtagttcacgatctgcatttccatatcgaagaactctttgtacttctggagaccgctggagcgcttaccagattcgtacaagccctctgggctacgccacatgataccttcatagcctttctgtcgatacacatcatgaagacgtttcagttcttcaaaggtggagcagaatacgtactcaacaaaacgaatgctccccagaccactgtgtagtgcagactggaactggaagtctaccagacgctccttaaatgtcaaggcatcttttacgatatcgaagacatggaactccatccgcttacgaagaccgtaaataaaggacgtgctgtccacttccttcaggagacgatcatactcctcctctccgttctctagagggtaagcgtcaagagctttctcggccttcatccacttatcgtaagcatcctctcgcttgaccgccgagttgatatcctccagcacctcaccgtggacgtacagttcgccgtcccacacatcaccctcttgcatgatctcttcgagttctttgatgatgtgcggtacgttgtaaggcttgcccatacgagacgctagcgtcaccttgccgccgaccttcttagccatgcatcgcagaccgtccagcttaggagaaccatagcctgctttatacttcgcaggatcgagcggcttggcgagcatagccattaccggcagatcgttgagttcttccttggttgcacgataacccttgtccaactgcttgctcaccttggactgagcctcagacacggcctgctcctctacagagcgtttctgcttgcccgcacggatgttggtaacctgagaggtcatggctccatgttctttgccgtatttcacgacgatattgaagctaccgtcttcctctcctaccacctctacagtccactccttgaacccgcctttcttgtcgagtccatacagtcgttgaaaataactcattgatcctcctcgtatttgatgacaagaacatcattctcccgtaggtgcctaagaccttcgtcgagccgatattcgtgcttatagtacactactttgatcccagcttcaaccaccgagatagcacaatttttacagcaagagtgagtgacgaacagggtagccccttgggcactctcagggctgcgtataagagccctcagtgcgttttcttcggcatgcctcacctctgccttggttactcccgtttcgtcctccagcggcccgtttaggtgctctggaagggcattatacccgcaactgatgatacggttacgttttactagaactgcaccaaccttggaacgagtcgagtcgctgcacttagcgaaggcctcagcggcctccatgtaagctttaatatgcttgaccttcacacctagcctccgccgacgaggacagcaatctcctcgtactcttcagtggatgcgaactccatgtaatagtcgtccgtatctgacaggtaaacaacgataggcggataataactccatacagggtctccgtgttcgatttcagctaccctcacattgccatacactgtgcgaagagtctgtagagcctcgatcacatcgtcgatgcgcattacagtgggttcagtcatatctcctccttagttttctactttacaaacggcatcgccccggcgaaggaacacttgcactgatggctttccgctccacttgtcccacgcttcagctttaacactgacagtcttaggattgattgcaaccacctcgcctaccagcataaccattccagttccgcctaggcagaatgctactgcgtcaccgatctcgatatcccttcctgctacgtccttcatttgtactctccatctgcacccttgattaaaataacgaagtccgagggatcatcactgccgtaggcctttgcccgaaactcctgctcgtatttattcaccgcctccggatcacttttaacctcaagctcttggtagaggtcttccataaaccaacccaagtccgtggtcgcagccgaagccgagaggtgaccaagaagtcctaccagcatattgatctcgtcgctctccaactccaacttgtgacctttacgttttactactttcatatttcctcctatcgcttctgtccgcgacgagtggctacgccgtaagctggcttgctcccctcacccgtgttgtgtttcttctgcactcggctggcattgacggtgtaacgtcctttgccatactcttcgtctatccacgcttgagccttagctcgctgagacgtgtggacaaagatgtagtagccagatgcatccttgatgaaccaagtggccgggggctggaagtccagacgtgaaaactcttcatagtcaatcacggtcaccttctgcttagccactgtatactgtcccactaccgactcttttgcaatgattttatcaatcatctgagttgaaagatcagggttcttcgctgtcaatttctacctcctcccctaggccatcatctgcaaagaaactgtcaaggttgagccagtggtattgagacactttgtaaccaccgctcttcagaaggctacgagcggcctcctctactttgtcctctgtcagtctccagtccgcacctaggagtacttcagctaactgctctacactcggagggttcccaacccacagccccattctattgtcaggctcgtattcttcttcccatacaagttcccacactaggttactcactgatatacctccttcttacgaatagaatacataacccactcgtcttttcctgtcttcccgcacggaatgtctatttcgcactctgcgtttacaatcaggtctgctacaatgcagtcaagaagctcctcgtctggctctggtaagcccgggtaggacgatataaccctgcggatagtctccgctttggtattgcccagtaccccgagcatgtggaggtcgaactctccactgtagtcgtcccagagttgtccaaatatcacccatacactattcatacctagtaatcctccttctttttgtccagcaacttcaggcatcgtttgcaggtgatatgattgcggtagcgggagaagttcttctcctcgaagtcgccatcggtgccacagaagacgtcatacggttcttcactgtccgcttctgtgccgccgtcccactcgtcgtagtgaactgttcgcgtcgccattcacttcacctcgattccggcttgctggagggctgctagacattccctgattcctcgattgaattcggcaagctcaggataagcatcaagtgatgagctaccatatggttttggcagcctcaccctcagagccgcgcggctggcttgccaagccttgaacgcaaggtgcgccggatagtccttgaagcagttgcgctcctcctgccattccgactcaaggccatgctcgcgcagtagccatgcttcaaactcgtctctcatactccgcaatcctcctgaatctcttttagcagctcggaaggcataaccgacagcgccagttcctccagagcatggatgtaatcctcaacatatttccattcctttctgatcttctgaaggtacacgccttctttgctgttgtcaatagattgacctttcagctcctccatcagttcgaacattttgtatatcctcctttggccgcaaaaatggccggcgactaatgtcccggcctgatgatactactctgaaatttcttccattgcaaggcgtttcttttcaaagaaatcgctgagcttgtcttctagctcttcgccaccgatgtaaagctcttcccctgccttgacacgctctagctccttctcagtcaagaagtcactgtagacgtgatctacccatttatcgcaccacgctgagctaaacgctgcattcctcaggctattcctgaaatcagcagatacaacgccaaaagaaggcgcgtggatcatgaaatatgtgaactggtcaatctcaacggagtcgcaggctagcgcgatggcagtcatggcagacgcacactcaccttcgagacgagcatgcactggagcttgacactccttgatcgctcggattatagcgttggcggtctctacctgtccaccgcatccgttaatggtgatgtacacttcatcattctgacctgcattttcaagggtccaaagctcctctgtgagttcttcgaggctcttgattacgtatggcagaaggatggagtaacgattgctaacactttgtgtacatgaaacaggcataatacctcctttacaaaaatgggcccgaaagggcccttattactgaatcactcctcgctttctttctggccagagcccagcattgcaaagaatggaaggaggattgtgctcagctctccgctgacagcttcaccaacttctgcaccagcctgagctacactcaggaactcttcagtgcgtacaaacttgtcaaccttgacgagggttttaaagtctactcgttccaagaacgcagtcccggctgcttccgccagaggttcgaggtttacgacttccatagcgcgatccagagcttcctgattgatctctaggccgttctgggctgcaacctgcatcagggtagacttcacagtctggattgcgtagtctttgaaaaactcacgttgtgctttgttaaacttcattcacttttctcctttgtagtacgacgacggcgggtttttggtttatcttccgattcagtctcttggacttcctctacaggaacttccttagctacttctgtagacttttcctcagtctgcttctctgcgccttctcggaccatctttacagacttgagagcgaaattcatattggcgaaatgagggtcttcgagatcaatgcggaaaccttgatcgaaagcattttgcatgcccatcagaaggctgaaaacgtcccattcttgcacaatgacctcattgccgtcaagctctttttcaatctcagggctgacgccttcctgccggaacatctgcacttgacagagggtaccgtacacaggatagccttcaatcgaccgaacgacacggaaaccttccttcatgtgggcgtgaatcgagcgaagccagacgatagggttgtattctacgatattgataacttgcatattcttttactccttgcgggttagtgttttacaataataccacgtttctcaggaatgtcaacccattttgttctggtaaaggcttgacatagaggaaatctgtggtattatcaatattcagcgtgggagagatatgtctgaaagcactcaccggcccacgcctagcgcctatgaagaggaatccacaagggcaacctgaactcgaatgctgttaaagggtggagacgacgcgaaagcggaatgacagcaatccgatgcagcctacatgctgcccctcaccgaactcatctgcatgagtaagaggaattggatagagccaaggcacgtcttaggcagattaaattctgtatggcgagccttgggacgactctatccttccctagccgaatctatctgcatggggtgttctcctgatacacatacacaaatacccaccacagataatccatcaatcaacccataaggaatttctatgagatgtaagtgctgtgatagcgaactctcgtttgagactccagtcatcaataaacatactggtaaggaagacgatctatgctcctcttgccgtaggtttgctctcaatcctacactggatcatgagtattttggtggttggtatccaagcgaaggagttaccgctcctctccctaccggggactgacattgtatatagagtgcgcgtactctgacaatacatataaataatagattacggtgcgaataattctttaagggcttgacaacaggagatttcgtgctataatcggagtatatggggcttacaaagcttcagaggatttaatatgactcaagaaagaaacaagggcggtcgccctacgaatgccgagctagaagcccggggtatcattcaaacagacctaaaagcaggactcagacttctaaagaagagctttgcagagaacattaggttcctacaagagcaatctgacaatcctgaggtttctctacaaatgagaatcaagctcaagaaagagctttctgatatgttcgtcgcttactacaaagctgacattgcactcaaaaaagagcttgcaaaaggaacagaatcaggagataatgagaacactgaagaggacaaggctcccggagtagttctcgcgttttgattaattgccgcttcgttcaatggtaggacgccagactttgaatctggagatgatggttcgatcccatcagcggctgccaaatgtagtaaaagaacattcacccgacaaggaatgtgtctcgctcagaggacagcgagtaataagtgtcctccagaattaagggtcggtgagcgtaactggcaacctaccggattccaaatccgtgtattctctgttcgaatcggagtcggcccgccaaattatatggaacttgaatccttctgggaccaagttcgcagccggggagctaggctatgctgctagcgaccgatgttctttagagactcggtattctctccaaattggtgttgacaggggagtaagtctcctgtatagtaacacaaattgctcgtatagtgtaatggacagcacaacggtcttctaagccgtaaggtctaggttcgaatcctagtatgagcgccaaattagatggacggaagctaaagtggatcagcatctggcttttaaccagacttatagtgagttcgagtctcacccgttcaaccaattttagtgagtaaatcagataggttctgaggctccctgctaaggagtacgtctgctagcgcggatgtggatcgagaccactgctcactgccaaaatcactgccaaaaataagtgatttttaagtgttgacaaactgaatttttcatgttttaatacacttatcagatcaagaaatacttagcgagtagccctgagtaggtcgggaactagtctagaaaactaggccactgcgatgagcggtgagggttcgactcctttactcgctgcccttcagaaatcagacctcaaggagagtcgatgaaaaagcaaaaccagctaggtatgaatcctagtacagcaagtaatagacttgtgaaagacctgttgtggaactttattgagactaccggaaaaggattctgctgtaaatgtggaaatcctatgacaagagacacgttctccatcgagcatatagagccgtggcttgacagtgatgaccctattggattatacttcgatatatccaatatcagctatagtcataggtcttgcaacgtcgctgacaggagagacacaagagtcctaaaaccatgtgggactacagccgcgtacaacagaggctgtcgatgtgacgactgtagagagtcttggagtaaatacaacagagctaagtatagtccagaggtaaggtctgaaaggtacaagaagaccgggcgttagtcttactcgctgccaaattaaggccctgtggtggaattggtatacacatcagtcttagaaactgacgccgagaggattgagggttcaagtccctccggggccaccaaattaagaatctcttttgctatttggttagggttcgagtccctacccggtcacttaaggccggtctatggcggccaagtagtgagagagctaggggactgacgaaggtagcgctgctttcagacctccccggcgctataaaagttatcatgaagggggttgacaaacaagaaattcatgataatataggtacatagagtaacaaacaatatagccggatagctcaattggtagagcacccgaccgataatcggatggttgaaggttcaagtccttctctggctaccagaatttacaggcccattagctcagtctggactagagcaagcccctgtctagggcaaggtcgtcggttcgaatccgacatgggtcgccaacaaggtcgttgtagagatagatggctactatcatccggctgtaacccggacgccataggctagaggttcaattccttccttcgaccaccaaatagcgagagcgttaagactggctggcgctgccactcggctcataaccgaacacaagtggttcgattccacctctcgctaccaaattgcactccgaggaaccctaagtggtgggttcagtgtcgctacctatctcggtaaggggaagcgcctaagctggcacgggtaattgagtagctgtgataagctactggcagccagtataaatcgtccggctcgggcccgttatagctcctagatttgaattagatgctgtaagccataggaggtgatccagtatctcccggaggggcccgggttaacaacctcatgaatttagcccgcgttggccgagaggtttaggcggcggattgcaaatccgtctcacatcggttcaaatccgatacgcggctccaaagtttaattccgtgcgtagctcaatggtagagcaggccgctgttaacggtcaggttgaaggttcgagtccttccgtcggagccaatttccaaaagagactcttcgctttagaagcagagtcgaacgcccgttacgggccttattcatctcctcgtagctcagtctggttagagtgtctgatttggaatcagaaggtcgaaggttcaaatccttccggggtgaccaatcaaagcgggtatagctcagttggtagagcgtctgccttccaagcagttcgtcgtcggttcgagtccgtctatccgctccaaacaatgcatttgaagctaactaggtagaagcgctgggttgaaattccagaggacttggatcgttaccaagcagatgcaccaaataaagcagttatagattaattggtttaaatcgccagactttcaatctggtgttccgggttcgatccccggtaactgctccaatcaagtccaagccggaacattcctccgtatgtgctttcagccggcttggcattattcgtgtggagattgtgtagcccggatgctgcctttcggttgtgacccgattgttggggttcgagtccccgcctccaaccaatgtcgtgcaatggtatatcgcgttgacgcttttaggctctctggatcgtaagccagtaaagcgagaatagcgggctctcgcagcagagcgataggtggttcgattccacaacatgacactctttcctcctcgcctgtgctgaacggtttcctcctcctttcccgtctcacaggctctattccctgccctttaagcatttatggtgatgcaccggctttgtaacccggcgaattctgttcaagtcaggaatggggcaccaattcacacccactatcaaagaacccgcaagctcccgatagggttcacactctataaggttgtagcatggaaaacactaaggttcctgataaaaaactcggaccaatcgcgctagcgattaaagaggcaagagagaatttcgatctcagccctcatgttattggtccaaaatctttcaaacagaaagagttcacagacagcgatgcaaagatcactgtattcggtggtgctgctggtgctggtaagtcttatctcggtgtaatggacttcatgaaatatatccatgatcctaacttccgaggtgtaatgactcgtcgtactactcctcagattaaaggcccgggcggtctgcttgaaaaagcaacagacctattcaagctcgttgaccctaaagtcaagtggaaagacaaagacggcaagtttgtgttctcttctggtgcagttattttccttcgacacttcgaacaagaatctgacaaagactccttccaaggttgggaggttagtaagttcctagtcgacgaaggtcagcagttcacagaaggcatggtgacataccttatctctcgtatgcgtaacccgaaatgctcggttgttccgcacatgaagattacatgtaaccctgattacaattcgttccttcgtaaatggattgaatggtggctagaccctgacacaggaatcccgatccctgagcgctccggcgtaactcgctggtttgtacgcaaaggcggtaagatgttctggggagacaccaaggaagagtgcattgcccttcatggtaatcccagtctagcgcctgacgatgaagatcaggtgaagcctatcagcttcaaattcatcgcggctaactgtttcgataacccaatcttgatgctcaacgaccctgagtatgtagctaaccttgaagcccttcctagggtagaacgtgaaaagctcctagacggtagctggcacgctagagaagagggagctggatacttcacaagggactggtgccaaatcgttccccacccgcctctacgggtgcttaaaagggtacgtgcatgggacatcagcggtagcatcgaatccgaaaccaacagaaaccccgactggacagccggcgtgctgatgagccgtacaaaagaaggcttgttcactgtcgaggatgttgtcagagagcgtaggttgttcggaggtgttttcgacctcattctagaaacagccaagcaagacggtcaagacgttgaaattcaaatcccatgtgacccgggggctgctggtaaagcttatgctgcccagctaattagagacctagcggatcatggattccacgccagaccgaagacaactaacaaatcgaaagttactcgattcgccccgttcgtatctgtagctgaaactaaatcagtgcaagtcgttgcgggagattggaacgaagattacttcgatgaacttgagcgattcgacggaagtaaggctatcaaagatgaccaagttgacgctacatcagatgcatttaatgctctatcccttggcagcttgattatccctgatttcctaccgcctgatatgactcaatccaacaaattcaaactaaattaataggaggcggcgatggccgagactgaaaagacagcaccgggtatcccgcgacttcgcctaggcgagattggtagtacaggccttaaacaagtcaatggtactattctggaagaacgccgaccagaacttcggttccctagggcatgcagaacattccaaatgatggcagaagaccctaccatcaaatcagctcttgatctcttcgaaatgatgatgagcagggttgactgggaagttgatctaggagttgaccccgacgaggctatgaaggcccgtggtaaattcctgaaagagtgcatgcatgacatggagcacagttggtactccttcatcaaagaggttactagcttctacacctacggattctccgtacatgaaatggtgtttaagcgacgtgaaggataccctgtatcgaagtacaatgacaacaaattcggtattaaaaagttgccaatccgctctcagtctactatcaccaaatggttgtactctgaagacggtagaaacttcctagggtgtgagcaaagtcttgccaatgttgtcaatggcgaccgttacgtcaacctaggtaataaggacggaactgtagagattccagctaagaagatgcttcttttccgggtcgatgctaaacgtgacagtcctgaaggtaacagccctctccgtgcgtgctataacgcttggagatatcgagtagagattgaagagcaagagtccgttggcgtaacacgcgatatgaacggtatgcctacgctctatctgcctcctcgatatatgtccgaagatgctacagaagctgagagggcagtctacgaatactacaagcgagtaattcgtaacattcaaatgaatgaacaatctggacttatccttcctcaagcgtttgacccagaaagccgacaacctctgttcaaattcgaactgacctcttcgcagggcagtaagatgtatgatacagatgccatcattcgtcgctgggacaacaaaattctgcaagccttgtttgccgatatgctgaagatgggtcaggaccaagttggttcttactctctagctggtgccaagactaacatcatggctatggcgattgaatcgcggctccgcgaaatcaaagacgtactagataataaactcattcctacgctgttcgcactgaacggtgattatagtccagacttgccgaagctgcaatacggtgagctagatgaaatcgatcttgaagagttctcgaaagggattcagagaatcggttctgtcggtggtcttgaacgtgaccgtgaggtttacaacaagattcgcaaagctctcaagattaagcctcgaccagacgacgagcctgttgatgtggataatatcatgggtggtcagtctcaagcaggtaaagctggagtaggtaatggtgcatcaacatccgcagccggtagagacaacgccgctgcaaataacgcataaggagacagaatgctgactcttgaaagtgttattgaagctctcagcaatgctttcggggctcccgccaaggcggaagaagccccggctgtagaggtcacaaagtccctagacaatgaaaagaggatggctttgtttgtcgttcttgagccccaagaaggcgactccacgactgacctacacgcagacacctactccgaagaggaagtagagaaagcttgcatcaacttcaatactcattgcaacgtagctaatatcttccacaagattgaaacacaggaagctgagattgtccagtccttcatcgctccatccgcattcacaactgacgacggaagagagatcaagaaaggtacatggctccagtggtggcacttccctgaaggctctgaagtagccgatgcactatgggaaggcgttaaatctggtgaattcacaggcgtctctatcggtgccagagctacagtcgaggatatcgaatgaccgtaaaagcaaaacgtaaactgaccgatatcaagtttgaacacgaaggtgctcatgtcgctctggtcagtaagctccaaggtggtgcagccaacgggcacactactctaatcacaaaagctaccaatggcgtaactgaagagcttatcgataaagctgctgaagttacagtcacaatgcagttccctgagttccttcgtaagttcttcgggatgtattatgaagatgccgaagttctctctgttgccatgggatatggcagaacggagtatccagaactagatcacaaagactggatcgaccagcgggtcgagtctatgtccattcttaagtcggtttataaatcggctgacctgaatcaagctctctccgagcttacccctgagcagaccctttcccttaaacaggatcaggaactgcttgaaaaggctctggaggtagtctccgagcaatccaatgaaaatccatccaaggagattaccaacatggaaactatcctgaaatcggcccacctagaagctctagctgacgctattgcagttgaaaaagctgctggtgtcgctgctgttgcagaagttcagaagcaactagacgccgctaatgtagagcttacagctcttcgtgaaattgtcaaggctgctgaggcagagaaaaccgctgctatcgctaaagcccgtaaagagcaactggctgaagtcctcccggctgaccaagtagaagatactttcaagtctctggaagttctggacgatcaagcttttgcacaaacagtaggaacgctccgcattcttaaagctgctgctgaccaaaatgacatgcttgtcgagaaaggtgtatcgggcgctggggaagaagacgactctgttgtcgccggtgttgccgctatcctgaaagctcgccacggctccaagtaatatctagccaatctagaggaattccaaatggctcaaaacattatcgcaaaagatcatcagcgtcttagcaactggctgaaagaagaacaaatgggccaccgtggcctgttctacactcgcgaaactctgcctgtcgctgacattgatgttaaaacaactggttctgtcctagacagcactggcaagctggtaactaaggctactatcgccgacgctacctacatcctaattaccgacctgcacgactatgccaacgctcagatgagccacgctgtcgtccttgctcgcggttttgccaagatcggctccaaggctgttatcttcggtgctgacgttgacgacgctgataaagctaccgtctttgaagctttcaaagccaagaacatcttcgccgttgaccagatcgaaggcgcattcgagaacgttaccttcgcgtaagcgagggtcgttccagtaaataaatactaggagtaactttaaaaatggctaacacccgttcctacctaaacgatggtcagttctacattgccgaccagactgaaaacctgcttatcatcccgaacacatggaccctcgtcgagaacatgggcgtcttcacaagtgaaggtgtgactcagaacactgtccagttcgaagagatcgaaactcgctacggtctggttaaggatgccatccgtggaactcgtcaccaagttgctagcgaccaacgtcgtcaactgcgtgccttcgcgattccgcacttcaaccaagacgactacatcactccagaagatattcaaggtaagcgcgctttcggtgctgaccgcgaagaaactctgaacgaggttcgtgctcgtaagctggaaaccatccgtcgcaactgggctaacaccgctgaagttgcttccgttagcactatcgtaacaggtaagagctacgccccagccggaaccatcgagtacgactggtacgacctgatgggtaaaactcgtaaggttgtcggcttcgacctgaccaaccctaccgctgacgttatgggcaagaccgaagaaatcttcgtccatatgcaagacaacagccaagacggtctgatccgtggtgacttcgttgccctgtgctctcctgagttcttcacggccctgattaaccatccgagcatcaaagagttctacaaagcttaccaagctagtcctcaatactggcgtgaacgtctaaccgctcgcggtctggaccttcgcttccgtgagttctacttcggaaacattcacttcatcgaataccgtggcgttgacccgtacggcaaccgtctgatcccggctggcgatgcttacttcatcccaaccgacagcggtgacctgttcgctcgttacttcggaccgggcagcactttcgatgacctaggaactctgggtaaagaactgtacgctaccgagcgtatggctgaagaccgtcgttcgatcctgatcgaaaccgagtccaacttcatccacgttctgcgtcgtccacagatgatcgttcgcggcactgtgaatgcgtaaagacttcagggaggcttcggcctccctttcgtcgtaggagggtaccaaaaatggcttacactggtgatccagcaaacaaccctatcgaccgtctacgagagattgtaggggacgtgtgggagcctccgatgctttccgacgaaacctatcaatgggtgttggacaagaacgaaggcaacgaaagacgagccgcacttgaacttatgcgtatgatgctcttccgcctgacaaggggaatgagagaacgcacaggtgatatcgaagtatatggtgctgagtatttcaacaactacttgaaagctcttcagctcattctcaaagacccgaatattacaatttctttggccgtgccatatgctggcggtatctccaaatcggatatgctggctaatgacctagaccccgacaacgtaacacgggaattctacatcggttttgcaagacgggagaagctttacaaccagtgcaaccccggtcctcaagaccttagcatggggtgtgattatcttggcaagcttcagttttaaaacagatcgccgtcgcctcacatccttgattaagagggtggaggctctagacggaacaacggtagaagttggtttcttccccgaggaccgatatggttctgaaaatggaaacctaccagttgcacaagttgcagcttacaacgaattcggtactactcgcaacccaacccggccattcatggctccaacctttgaagaattcacatctcaattccactacgcaagactaatgaagtctacgtttgaaaacgttatccgcgatggaagacaggttaatactctcctgaagaagctgggcagaatggttgcagagcagatgcaagttaacattgacgactacccgggctctaacagtcccgcatgggcagcttacaaagggttcaacgatccgttgttccatactggcaagatgcttgagtctgtcaagttccaaatccatcggaggcaataatgctctatcctaccttctccatgaccaactttgtcaagctagatttgattagaagagggcagcccggagacgacggttttggaagacctacccctccagttgagacagtagtgacaatcacagctaacgttcaacctatcgaaaaatcgacagacactcgtatccttccagaggccgacagaagcaaggcttgcttcaaggtgtactccagaggcgaagagattcgccagttaaaggaaggaccgggagggtggagtgccgatagattcatgtgggaaggagagttgtatgaagttatgaaagtcatcaactattcgatgggaatcctaaaccattacaaagcaatttgtatgagagtagagaagaatagtacagcatgatccatacagagctagaaaactctctctatcttatgataaaagagttgttccctgattggcgtgtcatccaagcatacacaaataatcaggaaccgcaaaccccttatctggctatcgatattaagaagctagatgaactgggaagggaaaatgtctccaacatgagcgatcccattagtccttcgcatggaactgttcaagttcaacaggacttcgcagccaaggtcgtattcgaactagttggcaagtatggagagacagcaagtgtctctgacatggcaatggcgattactcgggctctgcgtactccagcaggacacgccgcccaaagaaagttcaatctatcccttttcaaactccccagcacaaaacgagttccaatgctgagagagacagacatgtacatgttttatcaagtgacgtgtcagttcggattctctgtaattgagacaacggctcaagagtttgctgccggggctgacattcacggtgtgtattatgacgccggtcgcccgggacacgttatagagtcccacatcgacataaacttcgaacactaataggagacaggaatgactgttcttactgatgtaattgacattcagatcagccgtgagactgctgctgtcgcacagacaaacttcaacgttcctctgttcatcgcttctcacacaaacttctcggaacgtgccagagtctacaacagcctgaaaggtgtcgctgaagacttcggagagtccgatccaacatatcttgccgctgttcgctacttcggtcaagctctcaagcctcgcagtctagttatcggacgcagacaagttccttctgctaccgtctctgtcagtgttgttcaggaaggacaaagctacgtccttaccgttaacggactacctgtcagctatgttagccagcaagacgacactgctactctgattgccacaggcctaaaggcagcttatgacgtaactccggtagccggcgtaaccgtcacagacaacgaagacggaactctaaccgtcacagacaacgaagacggaactctaaccgtcgcttctaacgaagactggagcctgaaggtttcttctaacctgactatggctgctgctccctctactgaaggttggccggctgctatcacagcagttcaaggagaaaacgacgaatggtatgctctgagcattgacagccacgccgatgatgatatcatggcagtagctactcatatcgagggcaccaagaaagtgtttatcggagccactgctcaggctaacaccaagacttccgcagagaatgacattgcttctcgtctggttgctgccgggttccaacgtacggctctaatttaccatccaaacgctgacgctcaattccctgagtgtgcttgggtagggtaccaactgcaagagcaaccgggtagcaacacatggacccataaagctctggccgctgtagacgcctaccgtctgactccaaccgagtctaccaacctgaagaacaagaaagttaccacgttcgagcgtgttggtggtgtcaaccgtacattcggtggggctatggccggtggtgaatggattgacgtaatgatcttcgtagattggctggaagcccgcatgaccgagcgtctgtggttccgcatggccaactccaagaaaatcccttacgactctgttggtgcaacaattctggaatcggaaatcagagcccagcttaacgaaggaattcgtgttggtggtctggctgaagctccagctcctaaagtcttcgtacctgatgttctatccatgtctccgaacatgagagcacagcgtatcttcgaaggcatcgagtttgaagcccgtctagcaggcgcgattcactttgtacacatccgagggaccgtgactgtataagtctggtccttcccataaggagactcataaatggctgttcaacgtctagctacattctctccagccgatgttaccattgtcatcactcaccctgcaactggtgagagcatggttctcggcggattcagcgaagacagtatcgttaacattgaaagaaacgctgacacttacgtgatgtataccggagccgacaacacatcgactcgcgtctacaacgcctctaagtctgctactctaactgttagccttcaacaaacttcgccttcgaacgacttcctgactgctctttacaactacgacgacgcccgtcgttcgtctgagggattgttcacaatccacgttaaagacaactctggtcgttccgactacttcagtgatgacgcctatgtcggtgttgttccgggttctaacttctcgaacagcatgcagacacgcgattgggttattcatgcacacaacctgcaaactctaatcggcggtaacgccaagctgagcccgggtgatgcggatactcttcgtaacctaggtgtcacactagaccagcgctggctgtaatatagcgcttatgccacatcgacggggagctgccttaacgggtggctccctttgttgtttctggaggatagaaattgattaccacctactcgccgcgtgacgtggttgtaactctcgctggtatccattccgtgacagggtacgcagagggagagtttatcagaattgtaaaagatattaagcctttcatcaagcacggatcgatggacggagaaatcgcccgggtctacaacaaggaccaaggctggcgagtagagttgacaatcatgcaatcctcgccgaccaatgatatcctttcgatgctttacaacgtggacattgcaacccgaatgggaaaattcccactgatgattaaggacacgaagggttctacaagcttcctagctctgacagcatgggtggaagacctacctagggtatctttctctggacaactggagacccgcacttggattctagggtgctctgaggtcgccatgaacattggcggaaacgtcgatcaaagtttggtcgagcaagctatcctgctgggaagctctcttctgccagcccttacgcaattcggaggcttctaatggctaacacggtattgacatatagcccatctgatgttaaaattgtcctttgtgggtatgctctcactggtgtagtttctttcgaaatgtcttggctttcgagaccctacacaatggttcgaggaatcagagggcaccacacccgggtcttcaatagagacctttctgcgcagattagaatcgaggttcttcagacttcggtgtctaatgatgcattcttctcgctagtagagcaagaccgaagaacacaatccgcccgaatcaccttgtctgtcaaggatacccacggtagcaccatgatgagcacagacaacgcttatgtcaatggctaccctagcataacattcaccgatggaatcgagaacagggtctggactattgatgttctggactggaccgatggcacggtaggcggaaaccagcaagtcggcttcgacgtgtttggaactgttcaaggcgctcttagctacctcagataaataaggagtatttatgttcggaaaccaacgtactgtcatccacaatgggacagaatacactatcaaccttctgccagcaactcgcggtatcagcgtactgaagcagctaaccagcttgctgggtccatcccttgccaagtatcaagctgaccacgacttctctggagccatgaaagaactgttcgataacatcgacaaggttcctgttgagaatttgatccagaatctgatgctgacagttttcaaaggttcgatggcaatcaatttcgacaccgaattcgctggcaagtatgacctgctgtacgcactcacaaaagacgtgatcgagttcaacttcggctcggttttttctctaatcggtttcgcagaggcaccgacggtataaagaccggggatgggcagtccgagacttcagtcactactgatcgagttcagagtgatcggagggttagggaggcccaccagaagttctcgcagcattgggagatttatgtggctatcactcaccctctcaagctaacgacgtatggggaactgagtacagtcctcactacagaagatttgtacaacatccttgaggttatagacgttcacgatactatcactcaagtggcaaaagaacacgcagaggctgataagaaatgattacagaaaggattgcccagctaactggggaacttaaatttacagtcgattcccggcctctcactgcttttgacaagaagctcgctggggtcgaagcccggctaagagaattctccaagctgacgaacaagcggtttggagttaagctaactctagatacaaaaactctgagagaggagcttgccaaggcagccactcaaagggtagtcttgaagaacatcgcggtagatgctgccgctgttcgtcttatctctgagaagcttcaagaaagactgaatgcaacgccgatcaggttgaagtctgttaggctagaccttagcggtatccgagatcagaaaaacttcgtaaagacggctctcggccagaccaaggtcgatctaccggttgaactgggcttggctcaggctagccgtacgctgtatgaatggaagaagcgcacagagagtcgttttaaaattcatctgaatgcagacattagccgctctaaattgctccagaatgcacgaaacacactaagggatgtgcagggtaggctaaacggtcttgctgtcgctacgcctcaaattaggctgtctgtagaccgtgcccatcttcgtagagagattcaagatgttcttgagcaaatcagacgcgaagtgagaatccgcattgacctagagtcttccatccgaggaggtggtgcaggtggatcgagaggtacttccggccatatccgtcaaggtatgggaatggggattggtagcgagctagccgggtggggacgcgggtttattcccggccttggtggtgcgttcgctattatgcagcttaaccgtgcaaaccaagaacttcaaggtcagcgcctagcgatgcaagctgtcggaggcggagtacaaggtggccaagaactgcaagctaccctccgtgatatctctcaacgcctaggtctcgacgacagagcccttggtagctcctatgttaagatgatggctgctggacaggcatcggatttcagcaaggaacaagttgacagcatcttccagtctatggctgaatatggtcgagtgatgggccttgacggcgaagcgatgaaaggctctttccgagcggttgagcagatgatgggtaaagggcagattatgtccgaagaattgaaaggtcagttggccgaaagattccccgctgctgtagctctgatggccaagtctcaagacatgactatcgcggaactgatgaaaacgatggaagacgggaagcttaaaagtgatgccctgattccatttgccagaactctcgctgaagaagcccgtaaaggtggcgctttggacgcggctatgcaaggtacagccgctcagcagggccgattccagttcggatggaaccgcactatcgaggccttcgcggctggaggattcgaccgaggaatgagcgacttcttcaagattgctgcccaaggcatgaaagaagcgcttcctctggtaactgcacttggtggcgggttcgaagctcttatgaggcctgtcaacgctctggtcggtattggaggggagcttggttcccagtgggagaacattgccaagcagttcaacatgaccggcacagggctgactcttaccacggctcaaaccctagccttgctgacccctatgggcaggttgatctctgctattagctggggtgcgttggcactggaagacttcattgtcttcttggaaggtggtgattcggtgttcggggacttcttgaacaacaacgtacaagctgccgagacattcgaaaagctagccagtgaatccagtgaactgaagaacaatctcgacggtatcttctctgttgtcccggggctagctgaagcgctcaaaggtctagagttcaatgaaatgctggtcagcacgatgagagaacttgctgccatcatggagttcttcaacagtgttgtagagagattcgcaatagccggcaagtacagggacgctaagattgctgaagccggaggagacagaagtactataatgtcgaacatcgacacgatgtacgctatgttcaatccggaagatgcaaaagacaaggccaccttcatcggtgacaggctagtagctcagaacattgacgcgatccagacagagactcatacccgtgcaacccagtccttgactccagaccagtttgggtatatgatgcaacgtggtcaagttagaaacgaaatggagggtgccctcaagaagagtgccattgacattagtttcaacctcaatgtttctggtatcgatgcacagggtaacgtcatgacgactgaagcgcaagagcgcgtacgagagatcgtaagcaacgtgctggaagaagaaatctccagagcttcggcaagttataaggaatcccaatgacaattgctatcaaaagagagaacggagacctaatctggttcgacgctgttacagagttcggaagacagtaccgtggctctgtgagttccaacccaatcgaaacgggaggaaaaatcacagaccacattactacagaaaacccagtcttcactcttacagccgtcgtatcagacgcagacttcaacttgaacaggcccgttatcaacgacaacgaggcccagacatacaagatcaacaacaaagagttcgtgaatacgcagccggtcagtgtgccggctgttatcacaacttctagatttgatccgagccgaattttcccggaagttattactcagtttattcctcctgagattccgtctgctactgtcctccctcaaaagggtgataaagtcgcttacgatattgagcgccaactgatcgacatgcagcgtaacgctgaggtcttcagcttgctggactttagagacggtatcatctgggatcaaattgagaggtgcatctttactgacctgtcgttcagcgagaatgctgaaacgggacagagtattcagcctagaatgactatcgaggccgtgacattcacagacactcgctacattgaagttagggtgaacaagggaagaaagacagccaagaaggaaaagagagacaccaaagatggtgatacaggggctagcaacgctactggacaagactctcccacattcaagcgtagccaaatgaaagaggctcagattagaactcaggttgcgaggtaaactaaatgagcacgacttatatcgacacacttcctttgtaccaagataggaagtatagatacgcggtagctctggagggcatttcccgtgtcctccaattttactggaatagccgctctaggcagtggcacatggacatattcgacgaggagcttaatccaatcctaacagggttggcattgattccacaatacccgataattgcagattacgcgatgcagcacatcgggtttaatgggtacttcttgctcatgcctgtcaacctagaacaggtgaagtacaagcacgatgcaagcgacattgtacctcagttttttgaacttctgtatgttaatgttgatttggaggaagatgcagagtgagacaatacgacagagtatataaattgacgctcggtaatactgagtctggtcagggagtggagattacaaaccttcatcctgatgggagtgttaacagagagggacttcagttcaggttcgatatctctaaaagctccgataacaaaaagagcggcaactcggctactgttgagatatacaatctgtcgattgcaactctaaaccttcttgaaaccgaatacctcacttgcagactagaagtggggtataaagaagctggaacttcagttgttctagatggtaatgttgtcgaaacatccacaagaaagagtggaaacgactacgtgactcagcttattcttggtgagggttacactgctctaactgagactaagctgaagggcacagtatctccgggcaaaactgtaaaggatgttatcgaagagattcgtcttcaaatgccgggagtggacagaggagcttatacaggcctcaattgcaataacccgatcatgtacggctatcaactccgtggtctggccaaagacgctctaaacagcgtgtgtgaagccaacaatattgaatggaacatcagtggaaacgttctaaacgtcacagacgttaacggaccaacaacgaagagtgttcaaatggctcctctcgtaaacagagagaccggtctgatcgatatcccattctacgccagtgccagcggaacggcacagaagaaagataagcggagacggagaggcgttcaattcaaatgccttctcaatcctgagctaactcccggggttcttgtccgggtagagtcggatagattgtcaggaactttcagaatcaacaacgtccgaatctcgggcggatacagagacaacgaatggtacactgaatgttggtgttccgatcttaaccaagaggatattgaccaatgaggagaacaggcctacaagagcttctgaacctgcactcgtccacggaaggctcgaaacagtatactgccataccttgtgtggtattgcgcgttctggacgattttagacgcctttctgtcgatgttagaccagtggtcaatgacctgtacaaagacggcacatcagaagaacaaccagagattctatctgtccctgtcattatgccgggaacagctaacacccttatcagcttcccattgaatgtcggggatacggtgttgtgtgtattctctcaaagaactatggacgtgtttaaaggctctgccactggacagcctcacactccaaacgatcttcgtaagttcaacatggcagacgccattgccattcccgggctgttcaccttccctagatcgatgaacgaccctgcaagacatagttggccgcacgacaccaaagacctcactattgcccacaacctgatgactggacaagaggccgaggttaggatcaaagctaatggagacattctaatcaacagccgtaagactataagcattaatgcccaaaatgtcaacgtaaagtgcgcttccctcactgttgatgcagcccatacaacatggaacgggaacattgcacatacaggtaactacgtgcagactggtggaacctctacattcaacggtattccattccatacccacaaacacggtggtgttatgccgggcggtggtgttactgctgtcccacaagcttaaaggagatcatatggacttgtttgtcaaccccgacacacatgacttggtttttataaatggtgaagctccagtcactcaacgaatggttgatattgtcgctcagcgactaaagatcaaactgtacacattcttaggtgagtggttcttggatgatcggatcggcatcccctacttcgagaggattcttggtaagtctaggagccttcccgctgttgacgcgatattccaatctgagattatgagagaccccggcgtccttgagattacatcttggcagtcggggatcgaccctcacacacgtgaatactccatggagttcacagtcagaaccacagacaatacagaatcccttcccatcactttcagaatgataggagtttaatatggctggaattacagcagaaggtctaacgattaaagacttggaccaaatcctgacagactacagaaacgtagcctctcaggtcttcgccgacctagtttcaactggagacgaagttgacacgtctggtaactctgctctaggccgtctgatcggcgtagttgctccatcggacgaagctatctgggaagttatccagatggtgtataactccttcaacccggcagccgcaactggcgtggctctggacaacctagtgtccttctcggcaattagccggcatgctgcccgtccgacccgggctcaggttgttctagagggcaacatcgacaccgttattaactcgcctcccgcgaagatgatttccagcagtacaggccgagtgttccacctactacaaggcgtgatcctcactcctaaagcttgctctggtgttggaatcttccctcagacagtaggcaacgacctgacgtacgagcttaagatgtacgttgatgacattaacacaacgtctatcaagtacacaagtcctgccactggcacagtaacatccgagtccatcctagcaggactggccgccgacgtagctacaaatcacggaaataccttgacaagctacgaacagaatggtatacttttcatagtacctattgacccatttaacaccaagactttcgaagaagcctccaacctgagtattcagaaggttagaaagcttggtatcgctgttgacgacgttattggccctgtgcctcagcaagctctagctatcgatacgatctccattcctattgccggatgggacagcgttatcaaccctgttccagctatcactggccgtctgcgtgagaccgacgatgagcttcgcgagagattccgaaactctaaattcgtacaagccaccaacattctggagtccctaatcgacgggctgatgaacgtagaaggagtcgaggatgttaggattatcgaaaacgatacagacaacccagacccagttcatggagtcccgggtcactcgttccttccaatcgttcttggcggtattcctacagaggttgcacagtctatttggctgaacaagccattcgggattggctctgttggagatacagaggttcaggtggtagacagtctgggatatacccatagagtcaactaccagcgccctgtcgaggttccaatcgagatcaagatcagtgtaacaaacacaggatcgatgccagagaacattgaagatatcctacggccaaggattgtagcgtacgggaccgagaattacaagatcggagacgatgtaatttattctcgattctatgctccaatcatggaaatcccgggcttccaagtgaacagcctgacgattgccaagaaaggacaaactcaaggcatggcgaacattgaaatcgggttcaaagaagtggctacattcgccgcagcagatatcaccgtaactacggtgtaatgatagaaggagaattccatggctgtcaaccaatttgacagagaagattatctggaggtggcccgggaacgggtcactgaacagtttaaagagaagccgatctttgatcgcttcctgcaagtgctattgtctggtaagtttgatatccagaatgcactggaagacctccagactctccggtctctggacacagccaccgggaagcaactggacattatcggagacattgtagggcgaccacgcggtctagtgtaccaagatattttcaactattttggattcgctggaacagagcgtgcaggttctttcggaagcctgtcggaccctacggtcggtgctccatggtactcggtcggtgctccaactggtaacgccagagagccgagcgatgaagagtatcggatgatcctgaaagcaaagatcatcaagaacagaacaaactcaaccccagagcaagttatcgaagcttataaatttgtattcggggttcctgaagtattcctagaggagtacgctcccgctgctgtccgtgtcggcatcggtaagattctaacgaacgtagagcgtagtcttctattcgacctaggtggtgcaggtgcattgcttcctaagactatcggggttaactacacatacactgagttccaagctggccgggtatttgctacagaaggcttccccggaggacaaggcgttggagacctaaacgatcccactgttggtggaattctgaccaacctagtgacataaggagttataaatggctgattacagtcaactacctattgaaaatatttggtccacaggcggggatatggtagccccgacccctgcgcagcagcaaggcggatggggtattcagtcggttcctcgccaatggtggaactggaagtggaaccttcacgatactaacctagcgtatttgctacagaagggcatcccagagtggactagtacacaagagtacattgctaacaaatcgttctgcactagaggtggatttgtttacaaggctgttcgtacgcatacaggaagcgaccctgcacaagttagtgccaactgggttcgagcttttgcagattacaccacagctagttcagcactagggggcctgactccaagggaaggaggtattcctttcttcattagcgctacaggagctagcgtgtttgactctacggcctatggtcgcggaatgttgaatgtagctaatgcctccgcagctagaagctacatttcggctcaagaaagctctgttgtactgtccaacctgtccactgtgactagggctgccaacacggttccgtacttcaacacggatacctccatggctaccttcaacatcacagcgttcggaagaggacttgtcaacgcggctaatgctgaaaacgcaagaaatttcctaggactagctaactctgctatcattacggcagacccagctaacagggcacatactctggtctatagagacgctgctggtaacttcgacgctggtgtgattacagccactctttctggtaacgcgactacagccagcaagctcagggctccagttacgattaacggcgtagcgttcgacggaagccagaacattgttctgccgggcctagatacaagctacgccggggttgtagcgaggctccatattaatggagctaacatgaccggaacagataagactacccagttggctcttagaaataaatctgatacagattggattagcttggtggctcctgatgacagctcgttggtatttcaatttagagggccagaagcggctaacgccactctgcgggttaactctaatgttgtgttccacgcgggaaaccagtatggactaggagctactcaaactcaagccagagagcggctcatggttgacaggctggcacagaacacgactcagactgtgctgtacaacgcagataagagcaggtacttctggttgcaagataacggtgtttccggtatctgggacgcaacgactaacacccctctatggcgtttttctagactaggccagctcgactacggaacagtccctgttgcacaaattacaggattggccaactccgcgacaattccggcatccgcctccaatatgactaatcagattgttgtgaggagcggaacaggagatatcgcagtacaaggcgttacagcgtttggcgctgttctgggaacagactatattagagtaagagccagcactggtaacgctcacctagtattccagaggaatgatggagcagaggtagggcttatttggggaatcccgtctgccaactctctgaacttcaggaccgcaggcggtgcgacaggcatgtctctggctggtcaggacttgactgtagttggcagggtgaatgctgcgacactcaattcgtctggcaacgtcaactctggcaacagcgtgattgctgccgggaacgtgcaggctgctggccgtgtgtactgcggcgatgcttttatgagcagcaacggcaaccttactggcggagctttcggctcttatgggactcttaccaactgggtagattctgtatatgcaagaaagacggacgtaatgaccgatgcccaaatcttggctgccacttctagaggtagtgctcaggctgttggaacatatgtctttgcgattgcagttagcgggagcggggatgttgggactgtagtagctggtacgtctctaaggtcttcgtctcccgctaactaccatggaactacgctatccggtagctacaggtgcatgggtaggttcggagccggaggttctaaccagattaccttgttccagaaggttgcagattaacaaaataggcccgtaagggcctttataactggaggtgattttaatggaattcagaaacgttgtaaaaattaaagcggggttcgagtgcgaaataaaccatccagaattgggatggattccttacggcgctgtagagggatgccctacgtctcactccatgtacgtgaagatcgccgcagcgattgaagatggctctatggaagtggtagaaaaagaggacaaatatgatgactttgaagccagattgtggagagacaacgagctaacccgggctgaccgtcaagtagagattgctatcgacgatgaagacgaagtaagagagaaggcttggcgtaagtatcgttctgcactacgtaaatggccagagcacaagaacttcccatccgaaaagagcaaacctaaagctcctaaagaataaggcgaggtaatatatgccaaacattatgaagcctacgggtattaacgctatctggtctgaaaacggccagaaggttgacccgggtgctgtaaaagttgggcttggatgggtgacagaactacctccctaccaaactgccaacttcattgaatacaagcaagacttgttcaacgcgcacgttaaccagcacggtattcccgaatgggatagcgtcacagagtatcagggtaacctgagctacactcaaggcgctaacgggatcatctataagtgccttagaacccattccgacaagattccaactgaccctctgaacattacagccggatattggcgggtggcgttcgaggatgcaggggaggcggccaaggttcaagctaaccttgatcggcacgtgacaaactacaacaccctctctgggattggtaacgtagttattgcaagacagaacctgagtgtgtatagtaaggccgaaggcgatgcacgttatgccatgcggcacggcaacgggtctaacgtcttcagcgtcgctcccgcaacacagccaactcacgcgatcccgctgagccagctatcgactctcgttcctcctgcgaccgagactgtagccggggttatggcagttgctacgactatcgagacagaagctggagccaatgataccaaggctgtgagtccgctcaaggccgcacaggtgtatctgaagaagaaagacaacctttccggtctgtctaacgtcactgccgcaagagctaatctaggactgtcggatacagcgactatgccttcttctacattcctgaaggcaggtagcaatctggcagatgtgcctaacaaggcgctggcaagatcgaatcttggaattacaagtagtgctacccagccggaaacctatttcttgaggagcgctcagaacctagcagatgtacctaacaaggcacaagctagagtcaacctaggcctcactgggatggctacaacagaccctgcggcggttatgatgaaggcagacaaccttgctggattggctaacactgctaccgctcggtccaacctagggctaggcacagcttctactagaaatacaggagacttcctgtcgtctggggataacctgtccgacctcacgaatgtccaagcagctagaaacaacctagggttgaagggagcggctacgctcgatgtatggggtcttcctgcgaatacaactgccatggacttccagtccagtcagtcggatatttccagaggatgggctcgactaccaaacggccttctgctacaatggggaactggtcccggtctgtctgatgacacaaggacgaatattcaactccctgttcctgcccgcatcttgaacgtgcaagtgactgtaatggggacgtttaacaactccatcggcccgggcgctttcatgacggatatgtggagtaacacggggttcagagttagctgcaactggggtaactggtcttatccgttcaactggtttgctatcacttcaaccctgtaattcaggagtattaaaaatggctctaactgagcaagacttccaatcggctgccgatgatctcggagtcgatgttgccagtgtaaaggccgtcactaaagtagagagtcgtgggagcggctttctactttctggcgtccctaagattctattcgaaaggcactggatgttcaagcttctcaaaaggaagctaggtcgtgaccctgaaataaacgacgtttgcaaccctaaagctggaggatacctcggtggacaagcggagcacgaacgtctagataaagcagtcaaaatggatagagactgcgcacttcaaagtgcctcttggggcctattccagattatgggattccattgggaggcactaggttatgcgagtgttcaggcatttgtcaatgcccagtacgccagcgaaggatcgcaactaaacacttttgtacgcttcatcaagatcaatcctgcaatccacaaagctctgaaatccaagaactgggcggaatttgcccggaggtataacgggcctgattacaagaaaaataattacgatgttaagctagcagaagcctacaaatccttcaagtaaatctaggaaggttcctaatgaagaagctattgaaaagctggaagttctgggctgctgtaggctctgcaacttttatggctctggaggccatggttcatctttgggagcctatccttcctcccggcgtattcgccgcagtggccacactggtagctgtcggtgtgagaatttcggcagtgtttgtaactgctggtaaagtggaggaagcgatttcggaaaccatagaagatggctcaatagaaaatgatactaactaaactcaaaaactacgccctcgtagtagctgccgcaatggcagcagggtttggatatctgtcgttctctttgtacggcgacttagctgttgcgaagaatgatatccaatctcttcaagctgcgtctcgacagatggaagagcagttccagaaagagcgagcagggtgtgagatcaccactgggagactagaggcacatatagcccaaatgaagagccgacaggagcttctacaaggccacctgtgtgagcttgagtctctacccaacccaaccccaagggagacccaagaaaatgccacagagacgatctctgagccttctactggggatagtctggaccctgctcttacaagcttgctcgacagagctttctgttccgcagtaccaaacgatccttattgtgcccccggcaagcctgaccgaggaggttaaggtataccgagtggagcaagatacagtcaaggggctcgctagagcttacattctaaatactaacagtgctgccatgtgtaatagtcaactacagacaataaagctatgggcagaagagcagagggctctatatggaaagtaaagacggcaaagaaggcctaatcaaggtagctacacagggagttatatctctgctaattgctatcctaatggcttggtctggattcctaagttccagtctttctaagcaggaagaacgtatctttgcgatgcaaagagatatggtatccgaggcaaaacttaacgcactagagtcgagattcaatagccgacttgaaagtgaaattagtaacgtaagaagagaacaacaagaaaccaaccggtatttgattttgattatgaatgccgtcaagggtcgggatacagaaactcaataactataacccgttaacccacactgggagacaatataatgacaaggaaacaagactggccgctagtttcagcagtcggggctttgtttatctccctccttgtctgtatggctattctggctttcacagcgatgactcccgaggctcggtttgactctgtacgccagacctacgagattcgaattagcgaatctgagcggcggtatgaactcaaactgaacagactacaggatcagataaactcggcctcgtacacacaggatcggcaatcccgtttgcaatatgaagaactcgactcgcttaaaaggaagattagcgaacttgagcggagaataaaagaaaaacaagaataattaagccccgggagcgaaagcttaccggggctctttgttatgactgggttgcttcccacacttcgttaaacagttcgtcgattttggaggaaatcttggataccttctttttacggagtcgattagcctctggatcggagtgaacgaggctcacgtcgctagcgtttccccagtccatttctccgttttcgaacagaactttaatgttcagattattagctgctttgtcaatccctgcgataactccgatcaccatggcgttatatttctcgaatgtgggccttggattgtccatattcagggagttcaccttaacaacctgacccttcttaacgtcctctagtttcattttactacctcctcagtctagtttcattagcgtattgaactgatacctcaaagacttgaaagcctgtgggccatcgtcctccgctccttcatggatatgatgagcgatcaagtgtatcagtcctcggtctcctagcaacacagagctaggaatctcttttatccaagccacaaagcaacagaagtgtagaacttccggcatggaagccttgaagctggaatcgtccagcttcgacaggcgctcgtaagtggctttgaggtcgggatagcttaactgatacgtagcgtcgtcgtcaatatgctgatcccctctaactacatactgcaagctcatattacaccttcttgccgccttctgcaagacgtgcctctcgcttgtggtctgcacgggtcatattgtactcgatcttctcgatcatagctcctgcaacatccaaaccccggacattcgcgtagtccatgatccgaatgatagcgtcggccagctccacctcttccatcttccgctctggcaagtgattgtccatcaaatccttacggacgccttcagccgcttcggcgatttcagtggtaactagcatcagcatgtgtagagcgtcacgtttaatcggctcgcctgtgaccagatcggtgttccacttgcggttaacaacctcaagaccagtcatcattttgttaaaaccggtaacaaactcgaagacggactctcgttcgaatagttcaccgaacgttggctcttgatcttcagcaattgcagtactgaaaggccactccatccaagcatcgtagcactttttgataagctcttgttcatcaatgtacgagaagacaccctgttcctcaagctgactaatagcttcagccccctcgacccagacgcacgtaccaataagccttggatcgattctcagagaagtcttgtagacttctttccacgacctccatcctaccctaccattgccaaaatacacaaggagtggcacatagccttctcgcttttcctgctctggagtttctataactacaacaaacgccggaactttctccccatctgggcgttcagtcagtacgaagtctcccaagttgacattctcccgactagctgggcgaagagcttcctcgatatggtctttaactttactcattaacttcgtcctcctcacagaacatttcaaaataacaatcacagcataccagcatgccgccgtcatttacaatttcttcgaccgggagaatgcttccacagcattcacacccagcccgttcgacaccacctgcacaggcccaatagtccatcttcaccctccttcactcctccttcagaagatactcgttgctaataaccttgaaactaaagtctcggctcatgcttttgaacaccaaaccttcccggtacttaccgttcaacgcagactctccgctagccatttcaattacatcttgcatgtcttttggaacgcctacgtcccacatgtacaccggcacatgtttaacatcctcttcgccgtcatcagctagcgcgttcaggattcccagagtggccagtcgctcttctggaagatagtaacgactctccgaaatgttgtagatatcgtacacatagtactccggtttgtcaactccctcgaagttgccttgaatattcggtgcaaccagttcaccctgaagggcgatatttagaccaaactcccggagacgttcaccaagattaagctcttctgccatcgcagtgaagtgattggagtctttcttaatcacacgcttccagccacgacccttaaagaagttcttgacagccgtgaagaacccgatcttctcgtcttccagacggaaaccgacatttcgagacgccacgcctacttctccatccttgtgccagatggtgagagacgagccgtccagcttgaatgtcacttcaaacttctcgtccttctgatgagcctgatcgtaagccatctgaatattctgtacgcgagcctgatccgtcttcgggatgaagttggggaaccctagcttggaagtgccagtccggctgcccttgttgcctccattgatagctgcctgctcggaaggctttacatacttcaggatgcccattcgatcggtaacatcttcgtctactttcggctctgggctgcccgctgcatgaacaggtacgatcaggccttgactaagctctttacgaagcttcatggtcttgattcgagaatactcttttccaccttgttcgaccatattacggccacgcaggaattcaaaaatagggttgtctacagggaccatggagtccacttcaatgtagattgccagatcaccggcctgatactcccctcgtttgattacgcactgccaaccaccaacaagcgccagatcgaggctgtcagcgttaggatgggtcttcacatcatcgatacgaactactcgggcaagtacgcggtcttgggaattactcatatgttatcctccttgtttgaaaattggtatattacttgttaaaccagccgagatcaatagcccgctctagggccagtagcagattctcagcatctagaaggtcacggatcgcgatccaactaccactgtctcccggtagaccgtctgtgatatacacaggtatgtcactatactcactctttttaagcccgcaagcacaggctacattgtctccgaagacaatctcgctgacttcccttgcctcgtctcgaatatcgatcttcacacctaccctcctatgtttgaaagtcgttgtattctgccattctctcttcgcagtgtcaatagccttgacaagaaaataatccgtgatagagtaggctctctgctggagagaaatgtccacgtcactcaccggccagcagtatagcgtatgaagaggaaagctgcaagcgcaacctgagtcgaatctgagaacagggcagcgacgacccgaaaggggaaagctcagagcctataaggaacccatgttccccgctcaccgactcatctgcatatatgtatatctgcatgagagcgagaggtagaccaaaggcatgtcttaggcggaaaaatccgtatggcaagcctagggacaggtctgcctccactaccgatctatctgcatacaagagcttgacaaagctctgcaatccgtgtagagtgacttcaaatcaaccacagaggagtgtataaatgaaacatgttatttaccgtgaagaccttatcgacctgctacgcgaccgtatgaagctccaagctctggaggctggtggcgttgacaactgggactggtatgaggcctcgctaatcgactgcggatacttcgatgacgatggccgggagctagaggtcgaagctcttgcagattgcttcccaaccgtaggtgcgtaaccgtggaggagtcgaaagctaccttcaaagacccttaccctaggttcttcgacgcttctcgtaggtatggcgaaaccaacgactgcatggtggtgagctttgcagtcgtatggaacaccacctatgaaaaggcacaccagcacctgaaagtgaagtgcaagcgcggttaccggcaaggggctactcagaagcgcttcagctacgcagacacttggtgccctaagacccggatgctctaccgggaggatgctaaggataagactcttaggcagtttgctgaggaaaaccctgaaggtcggttctggatcgcggtaaagggtcacgctattgcaatcatcgacggagtgttgtacgatcacactaatgacaagagacgtaccatctggcactgctggcaagtgtggcccggagaggcacctgaaaaaatcgagaggaagcctgatccaatctcacctcctgtgagaaaggccccggactggtatgtctaaacacaaacatctgaagtacaaagaggaggatttatggaaattatttcgagagggacgctccctcaagaggctttgtttactgctaagtgtcaccattgcctaagcattctccgagctaagagatcggaacttgagtatgtttcgttctcattctgtcggcccggggagactgggtattatttcgcagagtgccctgtctgtcacgaagaggtgtctgcttgggttgcggctcttgtcattcctgtggcaccggccaccacggagtatatcacaaaggagcgtaaataatatggaccagttagcaggattcatgggcgaacctttcgtaattgcgttcgactacgacgagacgatcagtctctaccctctagccttccgaatcgtgatggatacgtttcgaggatttggaggagccttcaatgtgattgttgtcactgcacgtcatcctgacaactgcggagagctgctgtggctgcaagattacggatttccgatctactttacagcacagaaggcaaaacgtcgattcatggaagacttaggtataaaagtttcggtatgggttgacgacaacccctttagcgtggataatgatcttcctccgtggactgctaagcagtatgaggattatctcgaagcaaagaaacaacgagccattaacagagggagtaaagcatgaatatcaaagttggagaccgcgtagtactgaaggacgactgcatgacatacaccatccacgcgcgtcaggtggcggttaaggcgggttgcgaggaggagctgttatccacaggttttgttcatgggaactgggcagacgaactagcccctgcttctgctggcgggttgaagggcactgttgtattgcgtattgatgacgaataccttgcggtggagttagacgactataagaatacccgctatgctgtcacagtggtgttcgagtcggatgttgccattgataatggcgtagacgacgctgaagacgctaccgaccacctgctggaatcctcagccaacgcgcaacgtttgtacgagtctattgcccagctccacatcggtcaaacggttagcacagcagacgccaccaaggagggtagcaccgagtgtaaagctccttctccagccatcatggtccatgtcgtagagaggcttctcaacagaaagggtgccgtatgctacatcctgcaatacaagatcgaggacacttgcacgttcaagatggtagtagaagagaccgaactggtagacttcttggatgagatgcgtaagtcttatttccgctgcgtgctgctggaggtgaatgatggagttgtatgaccagtggagtaagtatatgagtgtagtaatcttggaagaggaggaggacgaagctccgtgtatgcggattatcgaagcgatgggagaactcgaccactacttccgagatttcctagattctttctctattaaaactgaaggaggtgtgtgagtatgagcaagagtaagagcgaagagattgcagttgaagcgaacgggctagagagctacttcatttcccactacaatggctgggatttgatggacactgcttgtctcggattttatatcaaacctgagtacgttatcgatcccaagattcgaaagctggagccgagcttcctcgaactagacttcgaacggtgccgattcgccttttggggaaatgaagatcaaggaagagaggggaagctcgtagaagggaagttgcagattatgaccaactccttcgagtacgtcttcttcaaggaggtttgagtggctagacagacttacgagtctgcatcagatagggcggtcgaggaggccgtccgttctgagcttgaagggcggtggaagtgttctcttcataagctacctagagcccactatatggattgggcagcctgccggaatggaaaggttgttagctttgtggagcttaaggctcggaataatgaaatgcagaaatatcccgacttctttgtgtcccagatgaagtggctccatgggatcgaaatacaaagggtgtttgacattcccgcattccttgtggtaaagtggacggactatacaggatatgtcaaaatgacagccaatggcgtcaactacatgagcatgggtggcaggattgaccgtggagactggcaagaccaagaagttatggtccatatcccgctgaaagacttcacacgtttataggaggacaaatgaaacgactctgctaccgttgtctgcatcttggagagcctgtcatgctccgtcataagactggcatctggtataagggttgcagtaaatgtggatcaggagtattctatggctaagaagaacccggtgttcaagtttctaaacacagtcaacaggccctcggtagagagggataaaaccaaatacaggcggaagcctaagcataaacagaaggagcgattaaatgaagaagggtgataaagtgaggatcaatgacgacgctgataccatcttccggggccgtgttgccactatcatcgcagtagacgaagagggttgcgttattgatgtgggcagctacgaagacgaaagcggagagcttatcgagtaccttcacctgttcttcgagcgctctgagttgtccaagcaggcgtaggagggtataatgaacggacccgagtgcagatggtgtggagagaaaaccgaagctgagtttgtagacgttgggtttggatggatgcagcaagtcactggaggcatgtgtcaccagtgtggagggtatgagaacggtcactaccagaacgacggaaggctctccgaggtcgagtttgccacctactggagtggtccgttcgaagattatgcggatttctcgccattcaatcatatgagagaaggcgactcgccatgaaggctacactgagaaaccacaatctgctatacatctacttccacacgttctcggaaatgaatgagtggttgacagagaacgctgtagatcaatggacagtcacgactctgggctccggctatcaggtggctgttcctatggaccgtgcaatgcgggaccaatacgtctcggagaggggttgacacgaacacaaggtgatgctaaactccgtggttgtctgaagtaaggaggttttatgtccaaaatgaccgtggcccaaattgcggctatgcacggtatcgatctgtattctgaccacaagaccgcttgtccccaatgccggaagaaaggcgctgacaacagcggagacaacctaaaggtctatggtactgatcgtaataccggggaacacaaaggtgcctattgttgggcgtgtgggtacaccttgctctctgaagagcaggaaagagacgcccggggagaagacgaagaggagtggaatttcgtgggaactgaatttaacgcagagatcaatgctcaaattaaagagcaatgctcgtatgatccgcgtggttatcgtggcctgtccaaggaaacttgccagtatttcggagtgctacatggtttcgacccggagactggcgagattgcaactcagctatatcctactactactaattatgaactcactggctacaaacagcggatcatgccgaagaacttctcagagcctatcggcgagaccgggaaggattgcgagctttttggtcagttcaggttcaagaatagcaacagcaagaaggtgcttattgtaggcggtgaggttgaccagctatcagcattccagatgctcaaggagtatgatgaccggcgagcaggcggtaagagtgattatgaaccgactccagtggtcagccctactatcggtgagagtggggcatggaagcagctacaggctcagtatgagtggctagaccggttcgagcaaatcattctctgtttcgacagcgatgacgcaggacgagaggcagcagacaaggcagccgataagcttccgaagggcaaggtgttcatgatggaaatgaaccgtaaagaccctaacgagtatttgaaagctgggcgtcaatcggagtttgtcagtgcattctatcgagcccgtacatggacccctagcggtattgtagggtctgatgcactcgacgctcgaatgtatgaagctgtgcaggttgagaagattcctctgccaccgttcgctaagaagctccagaaggctatggcaggaggcatcccgttgggccggattgtgaatatcggcgctgcatcgggcatgggtaaatctactgtagtggatgagttcactctgttttggatttataactcgcctcatatgccgggtactgtgactctggaatcggactgcggggagtacgcaatcaagctgctgagccgtaaggtaggtgagaaggcagacttgtacgagaccgttgaagagaaagtggcgttccttgatcggcaccgtgacgctcggtacgacttgtggcacaaggaagacggaagcccacgcttctatctgatcgatgaccgagacggaagcctagcagccctcaaggctcaaatcgaacaactgattattcagtttgagtgccgtgttattattctggacccgcttcaggatattctggacggattgagcaacgaagagcagtcggtattcatgcgctggcaaaagggtatgaccaagagccaccgagtgacgttcatcaacatcaaccacgtccgtaagagtggtggtggtcagaaggctaactcggcaggtgctgaactgtacgaagaagatttccaagggtcttcgtccatcttcaaatctggtgcagctaacattctgatgtggcggaacaaggacgcggagaacgagttcgaaaagaacctgattaacgtgaagctctctaagtgccgatggactggccgcactggcatgatgggcaactggtactacgacgtcgagacccatacaatctgggacttggacgattatctggaccgataccctgacaagcgccgtgagtatgaggcttggatggctcagaaggaagaggaaggccgagacacggaatactaaggttgacagaggggtgatgcttatgtatcatccctttcgtcgtttacaggaggaaaggaaatgcaacaacgatttgaaacaatcgagcaatacctcgaatggatgggaaataacaatgtcaccaacatgacttgggatatcgagtccacgggtctgctggatgaaacgtccatcgactacactgccagcccctacaagattaagcctagctacaaacaccactgcattgtagtggaggagcacggtggcaatattctggcattctacgatgggccgacctacgtctttgacgggcgagagtacactgagagactgccgaaagcgtcttccatgctccacactgaagaagttgtgactctcaaggactacactccggtagagtatattcacctgccgctgaaagagttcaagaactatgtggccaagcgtcggatcaagcgcgtagtggctcacaacatgattaacttcgaccttatgtcgatgaagcttgtggaagatatggacttcactatcggcgtagagcacagggatggcggtctgactacgtggtctgctgacacttggatgggcaagcaagtggtattcgacgataccctcgttatctccaagacttgtaaccctgacctgttcggcggtcacagtctggataagctgtctcgtcgtgcaggtggtgacaccaagattgacttccgtaagcatttggcaccggatgttcgattcctcgacttcgcagccgatatgctttactactgtatctatgacgtaaaggcgaacaccgctgtatggcactggttgcaggatcacgaagactaccaactgtccgaccgggacaactacatcaagaactggttgtcgccgattcagttggagaagaaggttgcagagatcatcacctatcaggagcaccgtggcttcgtactgaacgtggaactctgcgaaaaggctgttaaggacttggatgctaagatggaagaacgccgggcccgggtagagcctgtgctgcctcctcgaccggcaaccaagaaattcatggcagactacactccacctgttcgacagttcaagaagaacggggagatcaccacttacctacagaagttcattgaaaagatcggcgctcaattgaaagagggcgacgacagaaccatgatctttgagggtaaggagtacaagctgcctctcccggcagacgtaccgctgaagacggaaatgcctgctaagatcggggacacaactcacatcaagcaatggcttatgggtgagtttggttggattccatcagagtggaaagagactgatctgactgtggatcagaagaagatcaagcttccgatggaaaacatcgttgctaagatcgatcgctggctggatgtaacgtatagcacagcgtacaaggaagagcggctggacgggttcggggattacatgaagatcacccctcgtagcacccgcgcgtatgtacgtcagaggttgattgatcgtgcaagcaaggggggctgtaaggttctcactaaccctagcttcacaaagggccaagagaaagaaatgtgtccagacctcgaacgcattgcagaacagtttccgttcgcgaaggatgtgattgagtacctgacctttaagcaccggcgaagcgcaatcctcggtggcggcatggactgggacgaaatggaggatggagaggaaccggaaaaaggttaccttgcaagcattcgtcaggacggcaggattcccacgcctgctgacacttgcggggctgctactagccggatgaagcaccggaaggttgctaacgttcctcggatcacctcgttgtacggggctgagcttcgagagttgtttggggttggagatgggttcttccaaattggatacgacttcgattccttggaagcacgtaaagagtcggcctactgcgatcagtacgatccgacaaaggaatactgtaagtcactcatgatggagaagccattcgacgttcacacgatgatggctaagcgtatttccgagattatcggtcgtcaatttaaccggtctcctgcgaaaaacgtaaaatacgggtgtacgtacggtgctcaagctggtaaagtggcaaaaaccattggtgccgatttgcaaacgggtcaactggtattcgatgcgttctgggatgcagcattcccattgaaagcactgaaggatgacctaaccaagcagtgggaggccaacggtaagaagtatattgttggagtggacggtcgccgagttcctactcgttcggctcacgctatcctgaacagcttgttccagagtggcggtgttatctgtgctaaacgtgctatggtgattcatgaccaactgctggagaaagaaggtctgaaggttgactttttcaaagaagactggaagaacaagccggaattctgccaacagatgatcgcgtaccatgacgaggcgcagttggaagttacagctaagtcggttagcttcaagatgttcccttggtcccttgtaggcggtaagccggaaggtgagaaggagctagaggcagccgagaaggagttgaaagctcttgctcaggcttacaaagatgagcaactggcgaccacaggcaaggtgtggagtgatatcgcacactacagcaaaggcgaaggtggagtgtttgtagcctactgccgcgctggagaacttgccacgaaggccgtgagagctgccggggagttctactccactccgttggtgcccattgaactgaccgctggctacatcgttggtcgctcttggaaggactgccactaaaccggcacttagcgaggaaaggggcttgacaggcccctccacctcctatacaatggccgcatattcacgacatacagaggagaaaactcaatgactctagctttcgttatctatctcgttatgaccgtattcccagccctgtattcggcagggagttttaccttgatcgttactatcatcgcgtgggttgcaggagggtttgtttacttggtatcgattggtggccgagaaaatgaggcagttaaagctacactcaaaaatcacctacgacccttgacattcaagctgtttctaccgatcattgtaatcggtcatctggtcccttcgtctgagacggcatggtggatggttggcgggtacgctgcacagagcctctatcaagcggacgctactcagcaggttctcagcgaatctactgaactgctcgaagctctggttaagcgggctaagaaagaaactctgaaagctgtcgaaggcagcagcgagtgatacggtaatcacagaataggaggtatgtatgaacacggctcgactctacgtctacggcaaatcgtctatggtaggaatcactgttgacaacaaggccaaccgagagtactatacctctaaaggcttcgaggtatcggagacaccgttagccaataaaagcgtggctaacaaatacaaacagaaaggaggtaaataatatgtctggtattattcccgggactatcgtcaaacttacagacgtcgggtgtggagttacagtaggctggccgaaggccgctcgatacgtaggcgcgtatgcagtcgcagtagatggacgcgatatcggtctcccggaaggggaaatccggttctgctcccttcattggtccattgaccgagacgtcaatgatggacttggagactaccaatcgatgctcgctgacaacgaccgcttcgaaattgtagcgatcccgggtaagaagtactacgttaagaacgttgccgagcacagcgcacagatcggccattacttggttccttcggagccagccttgtacgtaggtttcgagccgggctggctgaagagcatgcacgaaggggagagcccgttctgcatgacttttaaaggactagtcgatattggcggtgaaacctctgacgagccgcagttccagaccctctaccctgagctgatactggaagagtttaaagaagaggcggagggcaaggttgaagctccggttgacgaagagaagaaagaaaaggttgcaaagcctgctgtaatgggttatgctgttctcgatgtagacggaatccctcttaaattctgtctcactcgcgaagaagcccgagccaccaagcgctggtggggtggcaaggcggaaggcgtatcgattgtgaaactgattaaaggagaggaggtgcgctaattgcgctaatcctcttgcagaatccgggaatgtccggtatgatcgtcggtcaagtggctgacacactcgcccagtctagggtacttaaataggagaaataaaatggcttttaaactgaacgtaactaccaacactcaatccggcaacggcggcatccgcaaggaagtcgattgggatgctctgaacaaccacgtcgtggaagctgctggcactgccgctaaagcacgttcgatcccgggttatatctccggcatcatcgacctcggcgagcaagagcagaacgatgcagaggttgtgttcactggcactgccgaagatgaaatccaaatcatcaaggaatatccgaacacttacttcaaggatggactggacaagcagactcgcaagcctgtacgtctgaagtgctggccgcagcgcgatatgcaacaaatcgcgatcactgtggacttccctcagatcgaggtagacaagagcctgtacctgaccggtaacagcaacaagtctccgcttcgtgtcctgtacaacggcgactttactctgccgggtcagaagactaagattgttggccgtccgttcaccatcaaggaagtgaagcacccgaacggcaaatgggcgttcgctaagaactccatgctgcacaaactggctgtagctactggcgtcatcaacgaagacgaactcttcaccaaggaccgcgtaggcgagcttctgggtaaagtggctcagttccaagttcgagtgtggatgaagccgggcaaaaacgacatgaaattcctcaccgaggatatcagtctggtcggtatggtgcctgaaggtgttccggttcctgaactggatgagaagtacatctacggcgtgaacctgtatggtgagaacgacgaagaggcagttaagcaactgcgtgccaacgtcattaacaccatcaagcgagccaagaactacgaaggttcggatatcaaggcgatgatcgaagctgttgaagctgcacgcggcggtaaccgctccagcggtgacagcgaggaacaagctgaagttaaagagcagactaaagctgctcctaaagttgagccggttcagaccaacgtcgatgacgacattccgttctaaggttacgcggaagtagaggcaatagaggggcttcggcccctccctttcaaatttcaaaggaggtaacacatgcaaatcaatctcggtcctatttttcttctggctgcaatcattctgtgcgtactgaagtctgccggcgtactcgctatctcttggactctggcgctcatgcccatctggattcctttcgtaatcatgctggttgttcttgtaggttttggcgtggtagctggtgtgctttatgccattgggagccgcagtaaggttaagtacagttttaaaaacaacctccgaaagaagtgaggaccgattatgagcaccctagttattgttcgagtacctgcgtacattctaaaaggccctacagtaaacaactccttctgcggggaggtctgggaacgagagcttttcagagacttgaagagtgctgcggggagtatcctcaaaggagagccggcttatgttactcttcctaacaatgtaaaccctgacactcgacagacagagtgggacattcaggttgtgcagttctaacccaaggggagcttcggctccctttttcattggagataaaaaatgagtgaaaaggaagaggatattgtcctcattgacggcgacctgatcgcctttaagtgtgccagtgttaacgagactcgctctatcatcgttaaaaacaaattgacaggggaagaagagacttggaagaatcggacgacttggcgagagaataacaaggacagcgaaggattcgacgaagacaacttcgaaattgaggaccatcaagaccccaagcacgtatcctatggtatctctgttgttaagaccatgatcgaccgaatctgccgccaagctgggtgcaagcagttcaagattctcctatcaggccctgataacttccgtgacgccatcccactcccgaaagaatacgagattaccaagggtaaaaagaccttcactcgtggcggcaggtacaagggtaagcgtacagggcagattaagcctcttcagctaggtcagctaaggcagtatatgatcgaagcgtatgacaccatcatccaccccggcgaggcggatgacttgatggcggagatgatgtataagaacggcgtaagctactccagaggggagaccactcagcgcgtgatcggagctaccatcgataaagacgcagacggcactctgggatggctttgcaactacgaacgtgagcctgttcaagtcaagttcatttcgggcctaggatcgctctacagggactctaaaggcaaggttagaggagagggtaggaagttcttctacttccagctactattcggtgaccctgttgactgttaccgtccggctgacctgtgtatcgggaaggacttcggggaagtggcagcgtataacatcatcaatccctgcgcaacggacaaggagtgctggcaagcgatctacgacacctacaaagcgtggtatcctgagcctgtcacctacacggcgtgggacgacacagagcacactaaagacgctgtagagatcatgcaaatgtactgtgactgtgcccacatgcaacgctgggcgggagatagagtagactgtagggctgttctggctaaacttggggtagacatgggaggtgcagaatgagcgtaaggcctcgcccttgggaagacttcccgggcatctggaagaccgaagccgcgttcttgagttgggtcagaggtggcattcgccgctacctttggtctaagaacccagtcaagcttgagtttgctaaatcccgaagaatcaagatagccaacaccaatgaaaagagcaagctcaggaatcccactgtatggggctacgtatgcgagcagtgtggaaaggaaactcctcaagctaacgtcgagatcgaccacaagacgggagaattctccctgaagcgagtagaggatatccaatcgttcgtggaaggtgttgtgtttgtccgaatggaggatttggcagtgctgtgcaaaccgtgccatgagatcaagacatacgccgagcgctacgggctaaccctcgaagaggcggatatagtgaaacaggctattgcaatccagaagcgaaaggggtatgataaggtcttcttgcaggagtctggaatcaaacccgcatccaacgcagagcttagaaaagagcagatcatcgctcatcttaaatcaaagaaggagggtatatgagagagaagtttcttaaaatcatgcggaagctgcccatccgggtaagggcttcccttgttatggcttggattgctctgttcttctggctcccggttgcaactgcgctaatcgttggaattctagagttcttcgataatgcaaaagaagagttaagaaacggatactctgttttgatcgaagttgccaagggagcttaccagtgcattaaaacggggaaggagctggagttatgaccaatctggctacatatgttatccgccacaaaaagaccaaagagctttggaccactcccaaagggaaacgtcaatggaccacgaaaggaggagcggccctagcttggaggaacgcatatgatagtactacactgggagcgtactatgctaaaagagatatggaacggtggccagacctgaacattcctctgatagtaggggccgctccagcacgtctggctagctgggaagcagcatcttttaaaaatcaatctgcttttgagattgttgatattgctgagtccttgaagcacgaaagccagttggtactcgacttgctgaaagacgttatcggatttgaagtaccggactctgttggagacggatacgtgcgtctaactattaaaacatccacatatgacgatatcatcaaactactgaaggagacgaaatgagcatgatggaccctaaagcatacttcatcaaacaagacctagaggaagccacaaagctcctcgaaagggcctacaatctactcgacaacgttcattgctatgacacggctgtgtacgaggacattgcagcgttcctttacggtcgagactgcgaggaggcagagtaaggtgcagaaagacattaggaaaactacatcggagcttcgagatttgtgtgaagctgtctctatgctagacgaggccttggttatgatgcagaaaaacgggctttatgatacagacttgtacaagcgcatagacgcatttttgtactaccagccgggagaaggtgaatgggaggttcttgaatgagtagcaagaaacactttgtaatttctgacactcagtgcaaaccgggtatcagcttggactacatggaagccatcggtaaatatatcgtagccaaacgtccagatgttgtgatccacattggagatcactttgacctagccagcctgtcttcctacgataagggtaaacgctcctctgagggccgtaggtactctgaagatgtgcaagtcggacgtgagggtctagaccgactgttcaagcctctgtgggagctacaggagcgtcaacgggctaatcggaagaaggtgtaccaacctcggttgatcttcacgctgggtaaccacgaagagcgagcagaccgggctgctaatgacaaccctgagttgtatggcaccgtaggcagcgatgagcttggtattcaggactacggttttgaggttgtcccgttcctcaagcctatcgaggtagacggaatctactacgtccactaccttcaaaaccactttactggtaagcctctgggtggtacagcgaacaacatgctcaaggctgctggtcattcgtttgtcatgggccaccgtcagcttctggactgggcgatccaccctacaatcgacggaaaacaaagacttggcattgtgactggagcgtgctatcctcacgatgaagcctacaaaggctatcagggcaacaatcacttccgtggctgcgtgatgattcacgaagtgaaagatggtttcggcctgccaatgccagtgagtctagactttatgatggagaaaggaggtttcaaatgacagtttataagttctggtgtgaatgggacatcggtatcaatgaatgcctgtggcgagattactaccagatggaagaagatgtagctcaagctctgtcagactgtgggattgaggatactatcgaggaactagagggtgcaggcctgcttggcttcgactctgttaaagtgattggttaataggagggcatatggctgagtttttcctttgggcggcccttgcaggcttgttctttatgtttagtatcactgcgagctttaccgccgaagatattgagaaagtgacttcaacatgcgagaataacgaaggcgtcaagtatttcggagttgacttcttcggagacggtgctgtacactgcaacagcggtgctattttcaaaatcgaccgcaaatctaaataatcgaaaaggagatataaaatgactgatttcaacatcacccctgagcaaatggaagaagcaatggcaggtatgaaccctgagcagcgggctctggtagagaaagccttgaccgaccgtaaatctctggaagattccatcgtgaccgaggacggtgaactagactatggcatgcttgcacgacacatccgcaccagcttgggtgatctgcctctggtaatgggcggccctgacttcctgaagctgatgatcttggttgctgcgatgccggagaccaaagacgatctcctgactctacacatgaacctgtccttcattctggactgcattcgtgaatcgattagcgacgaggagtaacaagtggaagagattgtaaaagaagacctatctggcgacgatctcatggttgactcagcagggctagatgccctgctggccttcctagagagtcagtttaaaggtccgaagggtgtactgaagggatatgtcactatgagagtgatgtgcgctaagatcgagagtcttgacgggtttcaagagttgaaagatatggaggtgaactttgagtaacgatatcatcgacgttcatgctgggcaaccgatttctctggtgcaacggtcgaagaatcctatcaatattcaatattgggacgccgataccatcccttacggcacagtcttggttgttaccgaggaaaggggtgatatacgaaagggagaattggtcgtaaggctggctagtagtgcagatgatgagcactctgttagggtatgtagattctctgatttcttcctcctaatggagaggggttataacgcagccagtctcggcgacgttaaacaagcgtatgatcttctgttcgaagatcacccagtgactacctttgttaactgggatcgggctcagcctttgacaaacagtgagcgctactacggagactttctgattggcggcgactctaaagggatgccactattcaacatggctgttcttaaaaatgttctgtcgccttacactgccgacgatgaggaactttcagctatgaccgggaatcccgagacagtagagcacaaagaagttgacgaactaagtgagagggacgaggctttagccgaggtcgacagactcaatgaagagcttgttgcactgggtaagaaggttgtgttcgccaacctagaagattacctaggcaaagaaaactatgccacattggaagctatggctaaccacaaggaggctgtaggtagcggaggctcctctagttactacactgtcaaggtgaacaaccccactacgaaggctaacatgccgtattttgcagagtgcaacgatatcatcgaagcgctggatatgcgattcggtcaaggcaacatgttcaaagcgttgtggcgggctgcggcagcacagaacctaggcaagctgaaggccggtaacgatgttatccgggactacgagaaagtcatcttcttcgctcagttggaaatcgataagattctcaaggaaaggggttgacattccgcccgaggcttgcgataataggctccaagttgaaacgaaggaggtgtgtagatatgatccagaaagtaaaacagaagctcatgatggtgcatcctatcctcgctagcgagatcgtctggtgcctcaccttcgcaatgcttcagtaaaacaagggagcttcggctccctttattgtatcaggatttaataaggagagtttatgcaaatttctgcaaaagtgattcaacacagttcccggatcggcctaggtacgaagaatcacagattcatcactacattcgaactggagtatcctcggtttattcacagtgaacttatgactcaccgactttttagtcgaaatgctgcaagtagtcgtgccattcctgttgcccatatgatccgacaggtggaagagaatcctgcgatgcctgttcactggggaatgaatcaaccgggtatgcaagctgagttcgaactgagtgagtgtttgcagcgtagctctcagtacctgtggaagaaggctgcaaagagtgcggctcggatcgctagcgcactaaataaaatgggactccacaagcaggtggttaaccgtctccttgagccgttccagatgatgaagaccgttgttacagccacggaactagataacttcttctacctgcgttgccataaagacgcacaaccggagatcaaggttctcgctgagaaaatgtatgaggctcttattaaagcgggcccggcagaggctctatatgacggagagtggcatgttccttatgtgactcggttccgcataggggatggtaagctgcgttacgcagattgtaacgggcaagaactgagcgtagaggatgctattaaggtatctgctagctgctgtgctcaggttagctataggaagaacgacgagactctggagaaagctcttgtaatctacaaccgattggtagatactaagcccgttcacgctagcccgttcgaacaccaagcaacaccgatgctccgcatctcggacaatcaaactggatgggaggacggtgtgacgcacttggaccaatatggtgacctctggtctggtaacttccgaggtttcatccaacatcgtcaactaattaaagggcacgtatgtaatgagtactacggccaagaagaggaaggagtttaaaaatggcagaatataacctgagtctggaagacctcatgctggtcgatggcttcaaagaggcgttccagagtaacaatgagaaggtagtaagggagcatctgtggactaacggcatggatgttaaaaactactcgtatgaaatggttttctgtcagcatcgcaccctgattggccgagtcgtagagggtctacgattctctggctttgagcgtacagacaaggagtggctgagcctcggttgcgcctctctggaagctcatattgcagcgtgtgatgatagtaatctacggttcactcttcgtaagatgcgaccagagggatcgacagaggcaacgttccacaattaatgcagtaggagtagatatggaagttacaaaggctctcgtagatgaggccgatattttcaataagatcacacaaatcaggactccaacggagtcctatgcccggaaatatccggtcattgtcgaactagcaaaccagcaactagaagagaagttgtggttctctagcgaaatgaaggtagagctggataagttgaacctgaagtttaagttggaacctcatcagcttcacgctgtaaagactgtccttcaactgttcctcaaatacgaactgatcgtaggcgaggagttttggatgggtaaagtagtccgaacgttccctcgcccagaggttaaactagcggcttcgatcctgtgcatgatggaattggcagtccacgctgaattctacaaccagatcaacgtagtgctggggatggatacagatgccgactacgtggcgtacaaggatgacccggagcttatgggacgtatggagtggcttgagtctgtgctaggcgacgaagacgatgttctttcggtaattatcttcagcctaacagagaccgcccttctgttcagttccttcgctatcttgaagagtttccagtgcaacgggtacaacgatatccctgtgatcgcacgcggggctaaccagagtgctgtggatgaagacttgcacggtgtagtttcggctgagatcatcaaccaatactacgcagagattggtcgaccattgtctgaagatactcggcgtgtcgagaagattcgacaagctatcgaccatgtatatgctcatgaatgtcgtattgtcgatatggcgatcccgggcggagaacttaacggcgagtcggctgaaaactataaagcgtttgttcgttatcgtttgaacgtatggtgccgtcgtctgggtctggaagatcatttcgagaacgatgacactccgatcaaagattggttcgaaatgaacacgtacgcttacaaaatgattgacttctttactccgggaatgggcatggagtacgaactggggtgggatgaagaggaactagcaaaggcttgggaagaggagctgaaatatgagtaagagagacacattcaactattccgaagctaggaaaaacagtcaagcagcaggagagactcctctgtggtatacgacggctggctaccagttgttcatgaagaaatattcaaatgagggagagtctgttcgctctcgttttgagactgtagccagagctatggctcagcacgcccctacggtgtatcctgagtggtgggaggaggacgaatacactagaggcaaggactgggaacaggtattcttcgacgttatgtgggacggttttgtaagcccatctacgccgcttctgtcgaatggaggcctccgtaaaaagggcactacggtgtcttgtgctggcggtctgatggacaacaacctctatgaccgttacaatgtaatgacagagatcgcagtgctaacgaagcacagccatggcacaagctttagcctgaccaactggccatcagaaggagacgctatccgaggcggtgagtctcaaggtgtgatgcctgtcattcgggacgttatcaacgtcatggaagaggtagcacagggttctaggcgtggtagctgtgcatacagcatcaacccccgccatggagacttctggaacgttatcgatcacctgtataagcgcacagagtcgaacaacgtcggatggcttctagacgaccagtggtgcaaggatatggccgagaaagacccggagaccttgaagcgatggaagcgaatgatgttcgtcaagctggccagaggaaaaggctacttcacgtttatcgataagatgaatcggcaccttgcagagccgtttaaacgggcgggtctacgctgtgaagcgtccaacctttgtcaagagactgttctcccggcaaatgactggtatacttttagctgcgttatcctgaactacaacctcgaactttaccgttcttggcctaagcaccttgtgtttattggtcaggttatgtctgattgcaacatcagcgaatacctagcaaccatggatgaggtcagcgttcaggaccgccgagcactggagaagatttaccgattcaccaaggacttcagggcgcttggcagcggtgttctagggttccacaccctgctacagcgggagcgattcccggtcggtagtatggatgctatgttcctgaacaacgccatcttcaagggtatgaaggagcaagcggaagcttgtaacagttggctggctgcggttctaggagagccggaggggtgccgtggactagggaagcgtaatgccactacgatgatgatgccgccaactaaatcgacggcagaactcatggccggggcttctgagggtattgggcttgacgttgctatgtgcttcaccaagcagagtgctggaggtgaattcttccgtgtcaacaaggtgcttctggagatcatccaagagcgcgggctggactgggaagagtgcgctagacagatcaacgaacgtaaggggagtgttcagcacgtagactggttgactgaccacgaaaaggctgtgttccgtactgctttcgaagtgagaatggaggactacctgcgactatgctctcagcggcagaagtacatcgaccaagggcagagtatcaacttgtacttcacgtcgaacgactcgccggcttacatttcgtacatccatcgtctggccatggaagacccgaacatcctgtcgctatactacatctatagtatgcggggagctggggatatctctagaacagaagaatgtgaaatgtgcatgtaaaaccatcggcccggggcttgacagctcccgggcctttgtgtattctgagcccatcaaacagacggagggtcaaaatgaacaagtttactgaggtctacttctcttggagtgcagcaagctctcgcgcaagctatcttatagataagggatggactgctacgctccggcgatcctttgtaggatcggagcttacgtgggtagtggagttcacacgatgaacaacgaactgagagaagagtttaaccggtggtgggcccgagaggagcaggaagagcttcgcaaatcttgtgctaaaggctgggcagagtatatctggaggtctagtcgtgaggccctgaaggtggagttgccgaatcctgaatactttggcgattactggtctggggattgggcctacaacgtagaggacaccagagacgcgctcctacaatctgggatcgaggtgatctaatggaaaaatattctaaaaagcgactgatgcaaactagtgagccttacggctcggcaacttacgcgctggatgtagcagccggtctacaaagaactagattttgtgaatttgcctgtgtaacggaggataatcgagtaattagcgtgtgggagtatagtgacgtcgagccagacaaacctgtgcatcccggtcagcaaagggtgctcgtacctaactactaaaaaggggaaagtataatggaacagactattgacaaaatccggtatatcgttctcgacaacgaacagcggcatgttctgaccctatgtcagttagccgttcataatctcctccgtgggattcagtggacgagagataagcatggtcagattcacatccatgatgttacaggcgtggaactcggtgtgcgtcaagggattatcgctgaagtgttcctgtacccggggtatactatcctagaggaaactgaggaatgaacggggcccagaaatttcacagcccggacggtcctgccttcaatcaaggagagctgtgggagagctgcgaagggcatgtggtcgaaattaaaggaactgagcgatatggttctgaaaagtgggatgttaacgtttactacgtctacgtaggtaagtcgcctaatatacccgctgttctagcgagccgacaggagcttccagaccgcgagttttcaaaagacgcttggaacttccaagttaggtatcagcaccaagctgacaaggagatttgatatggatatgttcgacaagtacatgcaagttatgtatgaccgggacgctttctcaaggcgagtcggggagttagaaaaagaggtagccgaactcaaggctaagatggctatcgccaagtgcgatatgcgtgtcgtgaaaaccctactggaggatatccaatgggtgtatcaggacgaagctatctatactctgccgggctacgtttgcccttgctgcggggaatctgcaaactatgggcatttccaaggcagcttcgataagggcccctgcctactggcttgtgtactgagccggagtgaagcatatgaagcctaatgttgtagactcactgggaccgatcatgcaccactcttgtcgagtctgtggcggcaagctatacatccgaggagtatgcactatctactgccctgactgcgagaaggcaacgaaagataaaccgttcgtcaggatgcagcttctacaggatatcgaagacagcaagagggttgacaacgaatagaagtgctagtaagatggccacatcagacagaggaggagccatggctacaacagagaagatcatcgagtatgtctcggcctgtatcgaacgcttgcaagaggacgtaactgggtactcggagaacttccgtgacagggcgttatctaatcgcacagggtatattcacgggcttatcactatggctgaaatgaatgagcaggtgagtatcgaggactgcgacaagctccgtgtaaagcttcgtgaagctgctgaggctgtgttgaacgtactggattccaaaattaactaggaggtgttctgatgaatatgaaagagattgtgcaggctttgattgtcgttgtcgctctgactctcgcagcaataggttttgtagtcgggattactgcgttggccaacaagagcgcgcccgccgaggatattgtcgtgtctactgaagacggcaccatcaatctcggtcgctccgtgaagagcgagaagctgctgtatagcatgtgcatcaaggtagaagaccgcaaacctgcttgtgaattcaccaccaaggaccgtgttcttagcgaagtgaaacaggttatgcgcccgggcgaggctacggcccgcgatattaagattgcagtaaacgcggctgtgacgtatactggtgagaacgggcaggaagcaacctctctgattaccccgaaaggtaagtatctcccggctggcaccccgtctgaagtacatattcaggctattgcgaatctgttcgacagcgtgtacaatgactacaaacaaaacttcagcaagatgtgaggaggactcatgaaagcacagcctaaagaagtagaaaccctgtccctcgacaagcgccccaaggcaggtgatgttgttcgactgcgatctgacggtaaaacctacgaggtaaatgctgtatatcccacggcagtgggctgggaagcgattctccgcaacatgtacgacaagactaagaccgtcactgtcagcatggagtggtgaaatgtccgcgactaacaagtgcgtcaacttcctccctgtcactccggacgggcgagtgatcgtccggttcggtaaaaagaggttaggatggctcggtaaagagggtaaaaagtggtattattacccttatggatgcgaaggcaggatcaaatccgaaggcttcaaaactctgatcgatattaaggcgtggattaaaaaccccgactcggtttggcccgggcccctagcttgagattgactaataagccgacgaatggtacaatgggatgtaggaaattccctactcagtataaggaaactagcaatgactagccgctggaaagaggccgtgtatcgcaagtactcggtacgtcgtctgcggcaggaactcgaagagttcaaagaagctagacgctttgcaccaaaccaacgcatccgtgcatggtttgatgctcatatcgaatttctagaacgccacttggctattcgagagtccggccaagcctacccagacgacctttggtaattaggtaattaggtgtgttgtaggtagagattcaaatcatggttagtggcaaggacgccacacttcagcccgcccacaaggcgggcttctttttgcctgaaatttgcggttgacaaggttggccggaatatgtaaacttacggcatccaacagaggagggaagaaaaatgcaattcaatatatcgaagcaactatgggtagctaaaagcgagcggaagggcgactataaagggacgcttttggcatacatgtctcaagtggacttcaataaagatggtagcttggctgccagcttcaagaaaaagcagcagactggtatgagctgggcaggtaagaatgccgagacttgcttcatagacaacatccctgtctcggggcatttcatcggggacagtgttgaacgctgggttactgagaacaaatatttccgtgtgacggaccctaggggctttgttctagaggttcctaccgggaatatctcgaccttgctctacaactgcacagtaatcaagggagttattcaagagccttgcgtgtgggttcggatgggctctcagcacgttctactgccggaaggctcctctctctacaaagaagctgtaagtttcgtagagcgaaaagaggcggccaaaaccgtcaaagatatggttgcaggggatcgatgcactcttcttagctacgggacagaggagaaactagaggctgtctacctcggacaggtgaagatcacttggcacctcttagctaaaaagggccggtactctagccgagggtggggtgggggtcggtggggttaccaccatctagagagggaactagatagaaaagaattcactgagaaagattcgaagtgggttagtgtgttcgctaagccggtaggaaagcggtggagtatccattttatcctgtctccaaaggcaaccgacattcaatctggaagcgtcccggatgaacttcagaatctcgacctagtgaatggtgtaaaatgggagtacaacgagaaagacgaccgcccatcttcctattactctgtgccggagagggtagttaagtgtatcagtgtggatgatcccctgtgggataagctgcacagctcttcggaggtgcggtggacccgggaatggaccgtggtcggagcagagtggcgaaaataagccaccattattttagaattgcccggcgagagccgggctttttcatggcaggggttattttcaaattatttttagatttctgggagtttcggccaatatgggcaatatgaaatttctcaggaaaaggctcagaatgctcgtataagagccgttcgagtgtaggtatggtgagctactacttagccgtagaaggacagtgtaacgcttaataggagggttagaatgaagattgacaacggtagcgcgtatgcgtattggctagcggatatgaaagagtttgtttctcagatggatgccacagagattgagaagagggcttgtatagcatacttaattagctggtatcagcgaagagtactgcacagaattaaacgggaggaatacgaggcgatctaagctagggaccggacagatttttagggactggatagattttcacaggctgcaaaattaggaactgggcagatttttaggaactggacagtttttcacagaaggggatttttctacagaggaatttcccctgaaatttagccggatttctcagaagggcggatcgttagcaggctatctaattggttagcaagctacctttaatcgttagcacactaactaaaaattcctaggacggacctcagttggcacgaacgttgcaagcccgcaccagtttcccgggcaggcgtaggcctcgactatccgtcgtgaaggcgatatgtagttggggactcgcaccccgcgtttaagatgcgcctattctactatgacaaacccctttgtcaacataatttttatggcacaatctttgcaattgcaattagcgtgccaacctaaatctcaggctccctcggtgtttatctccggtgctcggcctcctgcctgcgttgcccgcctgcctgtcattatacacaagctatcaagacaagcaagaaaaattatagagaaaaatctacataaaacaggttgacaggcctcctttatatatgcacaatgacccccacattcaacggaacggcaggtaagcagccatgctacatagtgaagcccgggcgatggccctacaagagatggacaagtggagcctcctcgaacaaggttggaaattcagtttcaatcgcaggatgaaacggacgctaggccgttgtaatcacgctaaaaagctcatagagctaggttacagctacgtatctgccaatggagtgcctgcggtattagatactatccgccatgaaatagctcacgctaaggcgggaccgcatcatggtcatgattccgtatggaaagagtggtgcggattgattggcgctaaacctgagcagtacgccagcacaaaggaaaaagtagtcgtctatccgtggcgactggccatccatcacggtggcggccagcttgaactactcaaccattacggtttcagacggactagcatggcgagaaaacaggtacgaggacggcctgaaacgttgggcaggttaatttgggtgaagaacgaaaataagggttgacagcttgggccattcgcgtagaatggccctcaagcaaagggaatcaccctgagcacccacgcaggaaagcagatatgaaagctctttgtaatcatcgggcactctacgcggcttacaatcgtagcgagcttggtcgtattgcggtagatttgaaccgctacttccctatcgagaaagatgatgaatgggaagacggcgcatacatgtatcgtcgccgcacctatctggtgaagcattcgaagggtacagcccgttggcacagcctttactgcaatgggaccgtccaaggcgtcggggttatccttgacgtgaaatcggtcgaacctttccgcacagcataaggagattcagaaatgcaagcttggaacgtataccagaatggccagttgatcgacattgttttcttcgatatcatgtgtgatgccgaagaggttcggaaatcgctggtcaaccatgacgggtatccgtctgatatcactgtggaggaggcctagtgatggatagcctttctgttaaaatcgttctctctgaactgagttacaaggccttgattcaagccttcgccttgcttggccgaacgctcgacctagacgaggggttggacgatatacttaatcttattgcggatgagatcgctttccgcgacggcctgccgcctttcgcagacgactgcgataaaacagagtggatgctccgtcgatgggaatcgctcccggtggtatcgtacaatatcgggcaggacggaccgattgtcgctcggtctatcgaagtaaaaacggcatgagggagaactgatgaccgtcagagtaggagatatcgtggctatccggggcgacattcggaaaaagctcgacggaacgtgccaatacacgcccgaacaattggtaggtggtaagttcctcaagcatgccggcacgggagaaatatggactggccgagtagagcgaatccggggcgatatggcacgagtaggaggaggctggcgtgggatcgaatactacgtactggtagatgaaataaatgcttgacaacctgattcactagctgcaaaatagcactcacagacaacgaagacgccgacaggcgaggagaaagcagatgcaaatgttcttcaaaacccgcacccaagcccgtgcaatggccaccaatggccgcaaagtggtagacaacggcgctcaagctgaaaagcgctgggctgtcaagctgaacaaaaaggaggcgaaataatggctaagtctgtcagtgtagatcgcaagcgttccatcctcgacgaagcgaaggatggcagtttcttcagcgtcgagttcatcaaggcagacggcaccgttcgaaagatgacgtgcaagcgccagattaaatctgcgtatgctaacggacagtatgccactcgcaaaccgaccagcgctggcaagccgcacctgtataccgctgccgaggtgctgaacatggaagagggtaaatccgctttccgtacgatcaatctcgaaacccttatccgtgcgaaggtgaacggaatcgagtataaattcgattaaaagcttgacagcctaggccattcctgtagaatggccctcaagcaagacaaacttaaacagaaaggagattaaaatggcacgttctatcaaggcttccgacttcgattccgcttaccagttcgaggccgccaaacgttccgaacgtaaagagtcccgcaaatcgcgtgacaatcgcaaagctagccgaggccgagctttcgacttcagtagcgatatgtaaggtttgtgccctgccggcaggcttaaatgccggcaatcctaagcccattcgtcgagtggttttaggattctcaaccccagcggagataccaaaaatggttcgtcaatgcgtaccctgtcccgatgctcgccatgctttttgccttgcatggttgttcgccatgccggagttcgccggtctgcccgctcaaaaggacataaaactctttaagacttcgggacagtgggcggtatgttatggctagacggcagcggctcccgtcgtgggttcaagaccagaccgaggatgaaacgccgctgagggataggatagacccgtaccttagcaagctcggcgaagtcgataagctagagggacaattgcgacgggtcagggatgcaacggacccggacgaatacaacgaaatggctaaggtactaaaagcccgacgccggaagataatgaagcaacgtgcccgggcctacggtctgccagaggatgagcctaccaatgtccaagggtacagcgtaccggaagaggttcaccgtagagccatcctgttaagcagtgtaaaaccttggatgttctggaccatcctgtctttctcgatttttgtgtggtttgttttgaaaaacagttgacacctcttcgaatacctgtagaatggtcagcaagaaaggcggacaggccgcctagctagataaaggataaccgtcatgaacttcactctcaatctcgtttccaaaaacagcaaaaccggtcccatgcctgttagcacgtctcataacggcacctgcccggatgcctgccctctcaaggctaaaggctgctatgccgcttatgggcctactgctattcactggaaaaagctaagcaagggtgaacgtggcgtagagtggaaagagttccttaagcaagtacggtctatctcacgtggggatttgtggcgtcataatcaagctggcgatctcgtgggtcaggatgacgttattgatgggatcgccctgatggaactggtgaaggctaacaaaggtcgtcgcggcttcacctacacacattacccgatgaacaatttcatgaaccgccagcacgtattgtcggccaatcgtagcgggtttactatcaacctgtcgggcaacaatgtagcgcacgcagatgaactggccgacctgaacatcgcccctgtagtgactattctcccgatggacgcggagaatgtaagctttacgccgaaaggacgtaaagtggtagcttgtccggctgagaaaagcgacaaggtgaattgtaagtcgtgcggcttgtgccaagtggccgaccgggaatatattatcggcttccgtgcccacggcacagcaaagaaaactgtcgatctcattgcgaagggttaacacaatggacgaatctgtttacgcaccattcaatcagtgtaagatgatgggcctagaacgaaccgtgcggagcctagcggctccaaacggatgcaaggtagtcttgtatcaggatcacaagaacaagcacagaattgtcgtatatgacgctctagggcagggtatgtccggggtcatggtgcaagcagatggggagattcattacaaggaaactcgcaaggctagccaagggcaaaacctaacaaggcaactacaagcccaactgaccgcatggggagtgaagtggtttccctctcagtaccagacgacggcaggtgcggcttgctacaaaggagaccggtaatgcgacagcttaataaatcccagctaaaggccttggggcctaagatcgacctagctctagagttagccgcgactggccggggcgatcttatgaacggccacggttccacctgctacattgcaaacaaagctggacacaacatcttgcggatcagctatcataactcccgattcgttgcatatggggctgagagtgtcagggtgactgggaatgtcattgcagcatgggtagaatggaagggcattaaccgggctgcaatcgacgctctgagtgagtacgggtatcatcctaacctgagcatagggcacaatgatgctcttaagactctgcgtgatatcgagcgttaccagtgacggcctcttactcgacagagaaacggggccagaggtgggccatcatccgtactgagcccggttatagaggtgacaaggtgaccgtgctaggattctgtatcaatcaaacgcacgctcttaaaacggtagccaaattccgggcttggcaagcgctgggctggccctacacactgaaagacgacagaaaataaagcttgacagcctaggccattcctgtagaatggccctcaagcaagacaaaccagccgttaggaggctagaaaaatgaaagctgtagctcagttcaaaagtgaggattacgcaagcggtgatagccgcaccgctaccgtctatgaagacgtctatggctgctacatcgtgagcgttttcggaactagcttgagcgagcccattgccttccattggggcccgttcgaggataaagaagccgcaatcgatggcgctaagtctgctatctaataaaaagggactacagaatgaaaatctccgctatcctgaaaaataacctcgaactttacggaccgatgactttcatgtgcaatttgatagaagatgatccgaccctaggggaagaggaggtaatcgaggctaagcggtttatcgaaagcctgctaggtaaacacttcactcttcacgctaagcttaagagtgaattgcgagaatatgacgcttactatcgcggcgacgccggtttcgggtctaaccgatgctttcaaatgcggcaattgtggtggaatactgtaatcgaacaacttgaggctcaagggaaatgacccaagctaactggtgcaaaggcgtccgtatacttggcgggaagcgggacggcgagaccgtcctgttcaccgacgctcacttcagcgagtcgatgggtatggcaggcggcgaccctgaactggtggaagctctgcccatgcctgcggctcttcgtctgctggtcaaatggaacaaactgtgcaaacaaatgaagcttgattaccggtacgaactgctgtaagctatagtctcaatcaaaacaggaatgctctaatgtcgattctagccttaaccctgaccctctgctctgctattcaatgcgatgattacatcatcgaccacacactcccgggccggcccgcagaatgcaatgctcggctggtagaggaggccgaggagtggggcgatgcgtgggtggcgaccaatgctgacgcccggctgacccgctaccttagccgattcaatattcaggttgacccgcgctttgttttcgattacgatttcacctgtcaactgatcgcagaggatgaactgccatgatcgctccacatatcaccaataaacaatcgcagcaacgcgccgccatcatcattcgccgagtgaaatactacgaaagccgctggctgcgcacggtgactttcttcgtaggagagtgcagcgagaatataaccgaacgtttcgcctatctgcggcacgccgaggagcaaatgaccaagctgaaggctgagtttgcagccttcccggtagagcatcggttgaaggctctcggttggatcaactggaatacctacaatgatggcctactagaggagtggattcacccggacagtgaccgagccatcatgctagagtatgacagcacaacttggcggccagaggcttgctgggaaaccaaggttgactcactgtcgaaactagcaatgctgtaaaataatgcccgttaggctgaaataatgcttgacgggcgtttttgtatctgtagaatgacaggcagagggaagcacaaagcttccctaagaggatatgagaatgagcatcatagatcgcaccgcagggcatgaaagccctaatcattgctacattgtgactggcagcattggccctgagttcgaacccctgctattcgctactcatacattggcaaagaagcatgcccagcagatagtgaaatacggcgaggcgaacgatgttttcccgcctttcgtgcctgttatcgagactcgccacaaggcagatatgaatcgcttcacgattcacaacaaaattccagaataggagataaatcgttgaaactctcaaattttccaagaaggcctcgactacgctatctttcacgggacgccgtggtatatgtgtgtgcgtctccgggagctagacttgccaatttatctcgacgacgtgacccgggacattcgatctatcatgaatgaagccggaataacggctgatggcgtggacgactactttcgggaaactggcatggctgatgcttatgtgatgacgtggcaagagactatcgattacgggagtccagcctatgcaatgtgggtgcaattttggttcttcgtaatctttgacttagctcgaaaagggcagtagaatagccggcagataatgtgatctaagggacgatcatgaaagacaagactgtagtttatcgaatcgagtgcaagaacggcgagggcccttatgttaatgggtgcatgacgaattcgtcttccactccagaacggcctgtccctgagcatgacgggataccggatgttcgctattttgaatacttcgccttcacgtcccctaggcagttagacgattggtttggcgatgaatacgatgtactgtctttctattctaccgcacggatcagagtctatgaggtggacaagcaacatgtaagggtcggcatccggcaatgtgtattccgcaaggcggaagcggattgcgtccaagaggtgagcatagaccagtgggttagcatggtacgcgccggactattgtccgcctcggtcacacaaactgtagctccacgtcctaccgagcaattgtccctagacctaggggatgactcggcctgcgaagcttcgaaagaaattttgaaaatgttcggtctgtagggttgacaccttgggccattcgcgtagaatggccctcaagcaagacaaaccgccgataggcaaaacctaaggaactataagccatgactaccgaaaacctttcctctaaagaaatcgaaaccgccgttgacgaattcctgaagtcaatcgatgttaccgtggccaccgtatgtcgaggtgagcgcaatagtgaaggttgggtgcatgacctgtgggatgtaagtttcatccgtggcgatggcctccgtggagttctcgacactgaattccgcacaggcgtcgggcatcgcaaagcctcgattcccatgcccgccgacatccgccgtctggcccctaacatcctgatgcgggtagagtgggaaaaacgttacatcaaggctgtagcacctgaggctacctgtatcctgtccagccttatccgggactctgaagcgggcggctacactttcgaggagttctgtggagaactcggctacgatactgatagccgaaaggccttcgacgcttacatggcttgtcagaatattctgaacaaggtgcggaatttcttcactcaggaagaaattaaacacatagcgaatctggtggatcgatactgaaaaaaggttgacagcttgggccattcgcgtagaatggccctcaagcaagacaaaccgccggcaggcaaaaccacaaacccggagactcaccatgaacaagccaatgaacactttcgcatacgcccactacgtcgcccgcatggacaaggcctctggcactagcctgccctacgccaccctgttccgcatcgccctgcgtaacgcctaccgcaagccgggtgtccgccagtacgattgtgcagcactcgtcgaggatatcaaagcgcgtgaactggtccaaaagcgcattcgggctgaaaaagcagtagtgatggcggcagtaatgcgtgcaatccgtactggcttcactgttagcgtgaaagatggcagcgatggcgagtgggtagtgaagaagtctaccgatatcaaggaaatttccgacagcctgcaatcgaccgatgaagatatcatccgcttccgcaagggtgacggcccggacaacatcgtcggctctatgtgggcaatctacggtaacagcgctggcgaagtgatcgccgactggaccgaaaacgccaccatggccatgattatggctccggctgagcggaagatggaaaaatacgctgaattaggtatctaatgcttgacggggcccgaaaagggccccataatgcacccataccaaccaagcaatcctagagggcaacaccatggctacactgattatcggcaacgtaaactaccataaccatcgtctagtcgatgaaatcgctggcgatgctggctacaagggtgccgcccgcttggtggacgaatgcactcgcaaaatcaccttgctagcgccttctggaatttctgccatcgacgccaaggagcgtgctgaagtcgccgcaatgattggtgagtatcttctggcaggattcgaagtttcgattcagcactaacaccttaaacccggagtactgacaatgaaacgccaatataccgactcttaccagtgcaaagcaatcgacggcatgatctctatcctcggcagcaagaaagttaccactcaagtgccgccgtcgatgaaagcctctcgaaataaactgctgaaaaagatgataaaatacgtcgcccgggcaggatggaaaccgtaatcgactaattatcacagccccggcgagccggggctcacaataggagatagaaagcatgaataccctgattatccgcttggattccgcctatagcgttcaaactgtccgtagcttccttgtggaggctgtagagagtattcagaatcatatccgcgactatgcgacgcatactgagtacgattcaggcttgagcccggtagcacacaatcaccgtctcgcaatcgtcaccttggacgaagattgccgagtgtttcacattcaatgcgagtcacccgatctttatctggctgaccctcgaatcgtgtttactgatgttgaaagcccggcatataccactcccgtgaacgagatcgaagagtatagttacatgaccgcatggcagcatatccgccaaaaagatatgacagcaaaagactacctatcggattgggctatccttttcgcctcgaaagagaatgtcattgatatcgacccgcgtcccaacctgaaaacgcaaatcttgcattgatcgaggagggtcatcaaatgaataacaagtataaggataacatcattgcggaatactgccatttcgacggcagacggccagtcctttccttggcggcacgatgggtccaccacgacagtcgcgttgtgaagctggcagcgctctttgcctgtgctggctatggccgtccttacaaagattgtattcgtgcctacaaggacgccaagcagcgggaaaaggatatgcgaaaccctgccaaatggaagctgagccgagcgactaagcgggctctacgggcccggctggcgtccaaaaagaaaccgcataaaggaggttgacagcctaggccattcctgtagaatggccatcaagcaaggggatgagccccaagcagtagaagaggtgagaacgatgcaagcgacctaccaagccctgaaaaccctccgcgatgcttgcgaagctgccaaggatgaaaaaggcaccatcaacggaaacaagctgaactcgcttcgcaataaggctgtcaaggaaatgcaagctggtggcgaaacctactctgatgctatcgccatggcccacgacttgattaagaaataccgcaagtaatcaatccgtaacaagccccgggtgaccggggcctctcataggaaagaccatgaaaaacgttcaaatctgttgttcgaagtgtggagccatcaacggcggtaacagcaaacacacttgggttatcgcattaggcaagaagtggtgcggtcattgtgggtccaatctcacaacccttcgtcgctaaccattcactgagacctaatcgaggagagatcatgaacgccactctggcacgcctacagaacgaacgctgtgcaaccctccgcctgatgctcctgccggaacatcgtgggtatcagttctctggccatccttgggccgagcgaatccgcaatctccacgatgaagctaagtgcacccgcagccatcactaaaccgcactaatccattaaagctctaacagcccgccttgtgcgggctttgttctatctgcgaaagcgacagctttcaagtgtaattaacatgtaatgttgtaacactctgtagaaggtagcaccagcatgacaagatagaccacttgtaacgttgacgttacatgtataacagcatgacagcgaaagctgtacagatagcattctgtccagttcacccctatcaaataaccccacaataacccacctaaaacctatcggttttaagcggcctgtagggccgtatatgaagcgatagcttcgctatgttagtctgcaccgtcaaggcgaaagccttacagcacgaggcttgtaggaggttttagggccatatgcgattagcataggatgttggttgttttgagtagattttgggtataacccctttccgcgctaccattgtcccgattgtgttaacgtttccccgattgtgttaagcgacagcttacatccgctctcattttgcaatgagaattgcgtacagttcatcatgcgcctcagaagtgacttcactttgcatgcggatgcatgctatagtataccctgtgatagctccgctatcccgttttgcatggcacacgatttgcataagcatgacaagggtcaccctcgaaagcgaagctttcaaagtgtaggctctaccctttattataattgcgactcaatttcgcgacaccagaaaacttgactcaagcccagtaaatacgttagactaaaagatggatagctgccgctatcaatagatcaaaattcacacaaggaggcccaatgacaagcaacattcatgccaataatgcccgctcgcctatcggcgaagaaatgcacatccattacgccaaaggcgtattccatgccatgcgacagcgatgcaatcccaaagaccgaatctataccggggcttcgctctgcgaagagtggtctaagcctagagcagccggattcgaatcgttctatgaatgggcggtctatgaggctggttactcagaaggctaccaactggacaaggacattctattcccgggaaacaatttgtatgctccgcatacgtgtgcgttcattccgcagtacatgaacaaactcttcacaaactgcggtagcactaagcgagtcaatgcaaaacccaagccagctaggacactcccgctaggcgtgcagataaactactacagaaagaacgggaatccatcctacacttcacaatgccgatcccttggcaagcaggcaacactaggttcgttccgaaccgcaatggaggcacacgttgcttggcaacatgccaagatagcagccatccatgaatgtatcgatctctatcagatggaagacgttcacagtgtggatatcatccaagccttgcttggaagggtagaccaattgtggaaggatattgatgcgggcagggagaccattttgttgcagtagcatctcgcctagcgtctcgacgcagtagtctcccatgggccagcggatacccgtctgacagtgcgagtaatccgatagcgaagctatcaaacgtatatgcatattccatgccaacatgtggaaagatttcacccggcagggcgggagcccgttggcattagttttgcatagcttagctgtcgctaagaaggaaagaccacggccacccattattttggatttactaagggttagggt

SEQ ID NO: 11 - DNA, 45770 bp, Podoviridae Bruynoghevirus
  misc_feature (1)..(45770)
ccccagagtcccccaggataacgttggggtggcctatccccaggggtatagcccctagcccctccctaggataccataaggctagtccgggggtcaaccccttgagataccgttcatcgggtggaccctagggtattcataagaaaaatcttagggtattcagggggtggatcggggggaatatcccttgatcccctattgacatcccacgataccctatgttaatcaaagactgtctatatccgggggtttgctgggggactgatagtccttagactgtatgaaaaaccagtagacaaccccgtaaagaatatggcgtaatggcgccgccttgagggaaaccgataggcaccgggggaaaccccaggggcttgacaaaccccgcggaaccgggtctaatggccccacgttctacctaggccaccatcccccttgccgcagtgctatccgggggctgccaaccagggaagagcgcccaagtcgcccaagtgtaaagccggcaggtatcgggggttgacaagggatcggtgaagcggtatagttcgccccacgtcaacggcataacgtgcatgactccctcgggattagcgtagccttgacaagcaagactgatggccactcagcaaaagagcctatgccagagaactggacgaactaacccccgtcagagggttgacaaggcaagcccaagcctctaacatgggcacccatcaggtgacggccacctggggaaagtgtaccttcgacggtccttggactgaacaagggagaaacccgaaagctgagggaataacgcacactccgaaagagcgtaggtcctggccttgtaccatagaaggtccgactggtagcctgtcccagcgcaatcaattgacagaccccgtggttcaagcgcgacggggagtatgatgggttagtgtcgaaggcttagcgcagagggcgaagcttggtagatacggcgaaggtaggggcgagtggatacgaagacccccgaggataaccgaggacagaccataacgacgacactaacgcggaaaggggccggctacgccaatgccaaggtttgccgataaacccctttgtcgtatcgggatgtgtgtcccggctgatgattcctaaaggatgaaacgaccatgactcaggctcttgacaaaaagctgcgtcgcaaggccaaccgcaaggccaaggctttgggttacaaccttgggaatctggggaaggcccaacagcgtagtgagcagaagtttgggattattgcaagttgtaacaagatcctcgacgacaagaccacttcgttgcaagaaaaggcaggggcgcgtaaacgcaaggctcttatgagtaccgactggcgtaaccgtgaggttactaaccttcggaactggtataagccgagcaagtgcggtaactctgccgtcatcactgtcgaagtaaacaactgaggtaattacaatgagcgactacaagcgcatcaacgggatcatcaagaccattgccaaccggggtgctgccctggacaagctggttcaaaccactggcatggatatcctcaagcacatcgacgagcatggcgaggtgtccttggcctgcaagctgttcaacgcgatgcctcaaggctcccgccggctggccctggcccactggttcatcgacaacggcaagatcgaggccaataccgacaaggaaaaggccaaggaattcccgttcgtcttcgccaaggacaaggccactcgtctggagcgtgccgcagagaaaccctggttcaagtacaagaaagagcgtgacgtggccgacgagttctccctcgatcaagccatcgccgccttcaaggccaagatccagcgtgccatcgacaagggccagctccaggcagcggacgagcgtatcgccgtgatccagcgactggaagtcaaggacgaagcgaaggcagcgtaacgccgggtgcgccaggggtgtgtactatgacgcgcccctggtctatccctagagtgcatggtaggtccgtgcattgtagcgatagaccatcaggaggtttccgtgggttactgtatctttgggcaggttcattccatccaaggccaggattatgtttctggtttctgcgatgcaagggtaggtttcgacgctggtattgtgtaccgttggacattcaaggacggtaaatttgcctgcggtgtctactccctggatggtatccgtctgaacatctgcgggtggatcaaatgaagtcaccctacgaagcggcccatgaacgtgcccaaatgattaaccgtctcaagaaactcactaggatgatccgggtgcatcccgatccccggtggattgttgagcgtcaggaactcataaggaaactaagcaagtgacaatcgctatcattgtatccagcattggtatcgcctacttcttctttcgtgattggaaagaggaaatgggtatctaaccccaactgatgaggccaaggtgattcctggccgaaacccccaccggacctatggtcgcaggctggggcgtcttgggaaatcaactaaggaaaccatcccgtgaagcgcaacgactaccgaaaggtgaatcggaacatgcaagccatcgaggccatcgaccgcaagattgccaaggctgtccgtgagttgactaactccggaggaaaccacgttggtaaaaccctggagctgaatcggctgcgggctaagcgtgcatcgctggccaaggtaagggcacggtgagtacatggaagtctattgtatgtgccgccatacgctcacgttccaatgggttgttgctggtaacgtgggtggttctcttcgtcctgtcctcgatcttggacagcatcccttttgcatcgtgaggtagtcccatggatatcaaggtgtggccccgcaacggcgtaaccctcagttctctggttaagtcccaaacctttctcatcaatggggatgtgtacatggtctgcgaactccgaagcatcaagatgaagagtgaatctgacgaggttcccgttctcaatctcaagactggcaacgtcatttacatgcctccgttgagcctggtatacccagtaactgccgagctgaattgctacgaggtgtaacatgaaactccaatacaacatgattaccagtaagatcaaggttgtgatgtggaatgaccttgagccgggttgcctgtacatcttcgcagaggatgacgggaagaagaaccccaaagtcttccagtacctggagcttaatgatgaattcttcatctgcgaaatcttcggcggacctgagggcgatgtattcttcagcagcgacgttgactgcgggttcttccccgtgactgtcaagtacgcagaggtagaagtccatcggttcggcccaccggactagggtgtgtactatgacgcccgcccaatacatctacctctggttggtatccaaggttgtcatccgtcgataccagcctaaccccaaactgtaccccaactggtccgttactcatatccgtgtgtcgatcttcggcaaacgtgcaggtatcgtctatgaaatccactgaaccccaagtctattggctggctagcgccgatggtgaattccacctcaaggtcatcaacttcggccagttcatcaccgaaaccctttacgaactcggcattccggtggaccacaaggttcatcgggtccactgaggtgcaaccatgtcaaacaccaccttcactgtagcagcaacccgcccccggaacgaccttcacatcagtaagcgggcggatggggtttatgtgaaccctaaaaactctggcgatattgtcttcctcaaggaaggtaataaggttgtcgtcctcagccagagcgggttcagcatcctcgaagcccagaccatgcccaacatcggggaactctacccggctaaggaggtccatgtatccgccagggtatgggggccgtatgaagaataaacccatgatcggccagataatggcccaggagcgccgcatgaagcgtcgtgtagaaaagcgggggtttaacatgagcctccaggaaggcacccaggagccccgtggtgagcttggtttcaccttggctgccgtaggtgtggagtccagccgatcggcttacttgcggcacgccagggaggctatgatccaatctggtgagccttgtccccactgtatgccagtcttcggccccaaagagggtcgttgttgcaactgcgcgagggattggtgatggatctcggtaatctttggtgcctcttgggtgtccatcggtacaaaatacttgatggtggaccctacgagattcgtcacaaggggcggttagtggaactctgccactattacgacctgaggtgtgatcgctgcggtgacgtacatcggaaggtggtccgcagcaaatgatgacatacctcctgataatcccagcgatcctggcctacatgtcggtagcccttttgatatccggggtttccgcactctttttagccgaccagaatggaatggtaggccagagagaccgggacattgcaatcgtgatgggtgccctgtggcctgcatcgcttccctggatgtgcttcatggctgttatctacaacccactggtcatcctcatcaagtcaaccaaacgactaatcaaaggagattactaatgcaccgcagagactttccttcctgctgtaccgcaaaaatctacatcggcatgggaccctcgggtaccgctgaccattacgccggcctcgcatccaacgggttcagcccccgtggtttcgccaaggaactgatcggcgctatccgtcgtgaatccaacgagggccacggtacgatggttttcaccgtgaacagcgagcaggtggtagcagataccatcctccgccgcatgggcagccactacaacccctgggcatccagcgacaaccactcgaccaaggtccgggtccacgtcatcaacgtgaagtctgcggcagatatcctcatcaaccatggggttctccgtcgtcacctcggtggcttgcaggactaccccggtaccgtcgagcactcggagtacctcgacaagctctgtaaaggtctgtaacatctaggccttgacattctgctggaagtgtggtataataaccttaaggtgccgggggttgctttatatccctaaggtacctaaggttctaccttctatcttcttcatcttaagaaagaggtaagaacaatggtcctcaagctctacactcgggtaatgctcctggctatccccgcatggataagcatcctatgggtagtaccccagatgctgtccccggctaacaccctgatgaacgccatgggtgccggccttctggtcctttccatcctgtactccctctgggctgtcagccatctgtactcctacgccggtaagctcactggcaagaagggggtgtagtatggccacggtaacaagaagtagtaaggggccaacgatccctctttacttcgaacgtaagtgtgattcccaggtctaccttcgggcggactgcttccaaaaggatctcactattccgatggtaaacatctgcaatgggagtgtcctatacacacatcctcgggagattcacatattcttcgctgagatacccgagggtgaaacgctcaaggtgaaggtgtgatgtactatgacggaacagatgcgaggccgcctccgtgaggcaatccgaaaggacttagagggcatcgggggagatacctccgacctctacgacaacatacataagatagacggcctgctgggccacccaggtaagcccccgaatgattggggcttctatgtactgatgttcgtcatgttcatcgcattgtgcatggtctacatcaccccccttctctacaagtaaggaatccctatgaagaaaatcctcggcctcctggccattgctgccctcgcgatcaccgcaggttgctccaaggttcccgctggctataccggtgtcgtcgtcaacatgatgggcgactccaagggcgttgacctgaaggaaaccccggtcggctggaagttcctgacccccaacgaggagttgttcaagttccccaccttcaaccagaacttcgatctggcggtggttactgcccaggacaaggacggcctgaagctggacttccccatcggcgtcacccttcgggctgctccgggtagcgcacccctgctgttccagacctaccgcaagggcatgaacgagatcgtaagcgtgaacgtgccgcaggtggtccgtaacgccgtgaacaacgccagcagcaagaagtccgccgaggccatctatggtccgggcaaggaagccttcgtgaaggaagtcgaagctgccgtccgtgagcacttctccacccgtggcatcatcgtcgaaagcctgtacctcaacggtatgatcggtctgccggcgcaggtggtcgaggctatcaatgccaagatcaaggccactcagacggcgatgcagcgcgagaacgaacttcgtcagacccaggccgaggcagctaaggctatcgcggcagccgagggtgagaagcaagcggctatcctggtggcacaaggtaaggccgaaagcctacgcatccagggtgaagccctccgccagaaccccggcgtggtagagctgaatgccatcgagaagtgggacggcaagctgcccacctacgtcaccggcggccaagccatgcccttcatcaacgttcgctaaggaggtggacaatgggtaagcgtaaggttttctacgagcgtctctgctccaacggtgaattgaccctgaacggcaacctcaaggccaccaaggtgtcggcaccaaccaaaggcaagcaacagcgccgtggcaccttctaagtaacttagaggtcgctagtaatacccctagtattcctgtcctgggggtattgctggctaactcaaccaaggagaaaacaaatggcccgtatcaagtatgccttcggtatgaaacccaagaagggcgagggtaaagccctcaaggtaatgacctcttcctcctgcttcggtacaatggaaggtccggtaacccacggctataagctcgacggttggaccttcatctgctcccgccgaagcaagaagttcatcgatgtgctcaacaagtgtacccaaggtgaactcaagaccatcaccatcggcggcaaggccttcaaaatcccgaaggtccacttctggtcttacgaaagcaaggccaaggattcccccttcgagaagtattctaacgggacggaaatgatttcccccacccatcacggaaaagaaggggtctgcggtatctacttcaaccccaaggtacacaccctggattcctggtaccccatcatgaaattcctcttcaagatgatctccagcggactcgactaccaaggtcgtgaagaggaggttcacctgaagcttgctgagaagcatggcttctggaagtcctacctcgcaatgtccttccacgggctgatagccaatggctacaccgggtatcccctaaccaactacatgttcagtagcgattgggatgatctaaagaagggagatatccacatccaatccgctgaagagtctattcgatccggtcgttggacgcccaatcggaatgccccaggtggacgtgagtgggtaaggggtacaccctggcgttctgaattcctgaagattcagttggacaaggtggaggtagttaccatagcacctcagccaaccatcttcggaaagaaagatccctatatgaccgtagatagcgaggttggggggtttatccggcttaatcccaatagctgcgaaaaacacggagtggtaaagctggggatcatgggtgagattggctggagtcgtgacataaaggatatctcactggccctcgaagacttcatcgagaaaaacttctgacaaccaaggagaaatcaaatgggaatgtatgcagcccataatgtgtactatgacgccgagggctctgttgtacaccaatactcggtcaagagtatggccgaatatacaaactgcttcggggcctattgcgaccggacctccgacgttgggggcgaccggtgggttaccggggttggccacctgttggtatctacccacgagaatacctctggtaaactggtggagttcctgaacagtgatttggtcaacaggatcaccgacggtggtatcctctcggcttccatcgactggcctacccgttggtgggattacaacgatgacctcaagaacctcagtgatcccgaccacttctctcccccaggacgccggcaggcagtgtacgttcgggttgatctcaggaagaacgcatcggccatcatctgtgccctccgaatgggcgatcgtctgtggtgcgtaggtgattccatgcgtcgcatcacccaggaaagccgtgataagatcctgggatgcaatgcagagatcctcaccctcgcggcttgtgcccaggtaggcagcactgctcattgcgacagctatccggcgatgttcccggtgactgctggtgaataccgggaaggatgcgagagtcacggatgggaagtggatgacagctacatcagcgaagtcatggatggtatcgtaggtgggtacaaggagatcacctacttcgatatcaagagcatccatgggcggactcgcgaagagttcaaggacaagctcaagcatcacgacgctgagttgtggcaagggtataccaaggacgattacctgatcgaatgcgacgggctcgaaggtgtacacaatgatcggatcctctccatcatggcacccatcactatcgacgtaggtgacccaggtcgggaaaggtctgagaccgtacccaccagtccctacagcatccccgaaatcctcgaaaaactggagaacatgcaatgaacaacgcaatccccctgatcggtgcagatcccgaagttttcgtcggctacgaccgtaacccccagagcgtcatcggcttcatcggtggaaccaaggaagcgcccttggctgtagccggtggtgccgtccaagaagacaacgttcttctggagtacaacatcgacccggccagcaccaaggaagagttcgtcaagcggatcatttccgttcgcctcctgggtgcccagatgctccaccccttcggcatgaacatcatcgagaacctgtcctctcacctgtacgacgaggaactcctccgcagcttcggtccccaagcttacgtcttcgggtgtgagccggactacaactgctggacccgtcgccagaacgtgatgccgaacgatgcacctccaaccctgcgcactgctggcggccacgtccatattggcttcagccacatcgagcgagtcaccaaggcgaacacccgcgaggtcatgcagatgtgtgactacctcctgggcctggcgtctgtcatcctcgacggtgacacccagcgtaagaagctgtacggcaaggctggcgcaatgcgctataagccctacggcggcgagtaccgtagcctgtcgaacttctggatcttctctgtcgatctgaccgagtgggtctatgaaatggcagtacgggcttacacctccaagcacctcctggaggagtacaagtccatcgtatctggcgatgaagtccagcgaatcatcaacgagaacgacggcgccgcggcggtagctgcacttaaagcgctgggggtggtatatgaatgacctgaataatcgccatcggttgtccggagacttcaacatgtactactcctccacctatgccttcttccgggtggacggcgagcctcgggtagtgtacgtggacgataccgagtccattggtgacgaccgtcaattcgacgggtttcgtctccttggcaacgtgtatcgccccgacggcagtaactactacggaggggttgtctacagcgaggtagaaagcgtgcggccctcaagtgggtactatgacgtctttggtcgtggggttcgtgatacctatgtatccttcctcgttaacaaccgtacccagcgcaagggtgtagatccccggaacatcttgctgaatcatggccaacaggctatcaccggcgaaatgatgatccgaatcttcacccaggccgaggaaatgatctctgctccctcccaccgggacttcttcatcaaggatggggttgtacactggaagggagtgaaggttggccagatggtggatgggcggctgtccgcagatgaacaattcaagaaccaggaggacttactatgtcagttattggcacacagatagggttccgtaagaaccagatcatcgccccggaacaccacgaggaacttcctgcggttgcttccttcgggttcgaagtcgaactggaaggcctcaacaactggccagaagtggatgggtgggatctgaagggtgacggctctctgcgggagggtatggagtatgtcttctccggtcccgcctctggccagagggcaatcactcgggttgaatcctttgtaagtgcgatggaagaaacccctccggctcctaccttccgttgctccacccacctgcacatggatatgcgggacgtagagtggccggtgtacgaacgaacggtcctgacttacatggcattcgaggatgttttcttcgatcactgccagccgtatcgtcgggatagtaacttctgcatcccgttcttcagcaacgactggctggcccagaccttcggtcgccgtatcctggccccggaaggtgaccgagagaaagtcttgggtcttacctcctggccaaagtattcggccttgaacctccaggtaacccacaacttcggatccatcgagttccgtggtgctcacgccctgactactcgccaggaaatggtaggcctgatgcagcgtatgttgtgtctcaaggccttcgccatggctcacgcagaaacccccctggaagagttcctcaaggtgctctccgaggtgaatctccgtgatgtgttcttcctgggggtatctccggactatgaaatgtctccgggtggtcgtgaaatggggatcgccagtgctactctcgcggtggcaaccatgggctttgttcgctccggggtagatcctctggaggatgaacagaaccgtcagcgacgtctccgggagcaggaacgtgagcgtcagagggttttggatcgtaggctgctgctggctcgatctactacctccagactactcgatggtgcagcagagcggtacaacttggcaatggtcccaggtacccaggttcgactggatacggcgattactgcggtaacttctctgcgtcgtattggtcaccaagtgcgtgtacgagaccttctggaggaccaagaggctcttcaagatgccttcgtactgctcatggataacccgcagcaccttcagcgccataccggcgtaacaatcgaaccagatatgtactaaggagaaatacaatgtgtggattggtaggcttctgtgccacaactaacgcgagtgataacgaaatcgctcttctcaaatccctcctggccgtggatattatccgtggtgctcacgccaccggtttggccaagatcgacccggttaagaacgaggtaggaattcacaagcgggcagtagatgcctacgacttcctggctgatcctgaaaccaaggagttcctggacaagggtcgggctcgcatctacatgggtcacaaccgttacgccacgatgggcgacaagacggaccatggtaatgcccaccccttccaggtagaccacatcaccatggtacataacggaaccgtagatacctggggcctgcacctgctggacggcaatgataagtacaacgtggattccaacatgctgtgcgctaccattgccaaccacggtgccaagaagacgttcgaggagaagttctctggtgctgctgcggttgtctggtgggactccaaggaacgtagtctgaacttcatccgtaacgaagatcgtcctctgttcatggcggttaccactaccgggaccatcgtatgggcatcggagcctgggatgctcaaggttttcctggagcgacccaatgctaagatccgcctgcgttctcctatcgctgaactgaaggccgaagtcctggtaactatcccgttcacggaggccggagtgcgaaagggtgcagaaccccagaccactccggtcacgtttctggacctcccgattcccgaaagcgaaaggcaagcagcggcatggtggagtcgttacgtcggtgtctcggactacgatgactacagccgaagccaaggcagccaagcgggaacgaaaggcagccaagcgggctcgtcgtatggaacgtctggcgatgcgtacgcaaggaacaccctccggatcaacaacaacctcgacgcagcaggtagcaccttcaagcaccggcagcttgtcaccttcgatgttgtcaagatcgaggcctacgcaaacggcagcgaatacggaactgtcactggaatcgagcgtgaagaaaaccttctcatcgaagctcatggcatcaacgtcgccaaggtccacggatacaccgtcctccgagggagtatctccaatgcctacttcatcggccaagaccgtgatctcaaggttactgtcgaggatctggcggtaagctgcctggacccaaagcatcggccgactcctggggagactaccccagtgttgaggattggaacgatctcatcggagacgaaatcccattctaaacccagggttcaagtcggcggcacctcggggaacacccctccggccaacatcacctaccccctgaaggtgcaaggccacaccttcaacaacgtgcatgtctttcgggacttcgtgtcccagggatgtgcatcttgcgggaagatcccaaccgcatatgaccagcgtaatcgtcatctgacggtatacgaaggtgccaagttcactggtagcctggatgagtgcgagttcatctgtggtgagtgtgtaatcgaaaataaataggaggtcaaaatgacccaagtaacgatgaagcgtcaagtagtgatccagatggagacctacgcaacccgtaagtatcccttctcccgtgacaccctggacaagatccagtcgattcgtcgagtcaaggagcaggaactcaatgatgccaacccggacgaggaattcctggtaccggccccggtagtcattgcggaagctatcgaccgactcttcgaagactacttcgagtaaggtagtgcgttagtaatagcccctggccgacccatgccggttcctaagatgcgtacatgggatctaacttaggattccaggggctattgctggcttcactaccctcaacagaaacaggagatttgccatgttctatatctataaaggtgcccgcccctctgctggtgctgtcgctcttcgtaacgccctgggtgctcgaatccttcgttccgaggggtctacctatcggggtcgtgcgggtactgcggtaatcaactggggtaccgttggtgcagaggctcaccgactccgggatattgcccctgtgttcctcaacgacccggcagttgttcaccgctgctctaacaagctggagttcttccgccacttcgaggccaatgctccccacctgattcctcgttggaccgagcgctgggaagatgccttgggtgtactcaatatctctggtcgcatgtatgcacgtaccgatctgaacggccatagcggtcgtggtatccatctggtgtgtactgtcaacgatgcagaagttgctgcaatcgatgctctccgtagacagggccactacccggtacacatctacggtcacacccacatcccggatgttatcaccagggcacaactgttcacccagggaatcgtcggtaagcgtaccgagtttcgagcccatgtgatccgtggggaagtagtacttctccaagtcaaactccgacgtgttgccaatgaaatggtgaccaacgaaggacaaagcatcgttcgtaacgtagctggcggctgggtctacggggttaacgatgcaatggaccgtgatggtgctgagcaggctatgtcggcagcggcagaggcaatccaggtggctgggctggacttcggtgcagtagatatcatcttccagcacgccactggccgggcctttgtcctggagatcaacaccgccccaggtctggacgctgaaggcagcgccctggaggcatacgtcaagggcttcagcaaaatcttcgaggagactatctaatggctgttcgtgttttcgtttatggtactctcctgtcaggtttgtacaaccactaccttctggaaggggccgagttcatcggcaatgctgtatcctgcgagcggggtctgatgtactccgctggcggcttccccatcctctccttcgcctcccgtgctgacctcatcgtaggcgaaatctggcaactccccgtgggcgaagcgggggatgaaatgctggagaacctggatgccctagagggttatccgggttggtatgatcgtaccctcaaggatttccgaatcaatggggaacgcatcaaggccctggtgtaccatcaggatagccacatggcgatggatatcgtccaagatggcgactggaaggcacacctggcaaaacgacaaggagcagtataatgaacgaaatgaccgtagacaaagcagtagaagtctaccgcgacaccccgaacaccttcggacaccaagaactacatgcccagaagatgctcctcaaggagatcctgggtcttgtagcttcccagcgacacctccaagactccatcgaggtctccaagattccggaggcctcggacagtcccgagaccagctacggtgggtactgtgacgaatccattggcattcgcttcatgtgggagcgattgaagaaaatcgaggatcgtcttcgggaactggaggaagtctacggtaccttcgtaacaactccctataaaaccctaccgggcaacgtgaatgctgtaccaagcctggttctcaagagtcaactggaggggtaagtgaagaagatcatcggtgatacggcttgtccgggttgccgagctaaaggtggggataaaacaggaaatcacctcatcttgttcgttgatacagaaaagggtactcggttcggaagttgtaaccgttgtggtcactacgaggtcctcgaagagggtttcaaggtaccagagcggagggagaaatctgaagaggatatcatccatgaagtcaacgaagtccttgagtatccaactaaagccctcgatactcgaaagatcagcaaatcaatcgctgaacgatacggggtacgtgttggtctatcacaagaaaatggtgaggacgttatcgagcattactatccacgcactcgcgatggggagtaccgagcgtttaacgtccgaatcctagagcccaaggccttctactaccgtgggagccccaagggcggtgtagaccccttcgggtataatacccttcggcataaggatatgggacacctgcggttagtcatctgcgaagatgaactgtcggctatgtctgtggcccagatcatggagtcgaaactcccggagaagtggaagcatcttcgtcaggcatccattagctggtcctcgggtgttggttctgctggacgggacattgcattccttaaggagtctggtgtccttgagaggttcaacgaggtcatctattgccacgatgcggacgacgaaggccgtaagtcagtagaaaaggtacgtgccctgtaccccgagtgtaagtttgtcgagcttcctctgaaggacgctaatgacatgcttatgcgtaaccggggggatgaggtttaccagatgatacgtttcggcagcaaggtcaagtctccggactgttccgttactgtcgatgaggtatacgctgaggctctggaacccccaaagtggggcaagagttacccgtgggaaggtttaaccaacctaacctatggtcagcgggatggtgaaatcatcggggtaggcggtggtactggtatcggtaagaccctgttggcccacgagattgctgcctggaattgcattgagcacggggagaacgtagggaccttcctcttggaggagcaggtagccatgacacttaagaatatcgcggggaaggtagccaacgtgcccttccaccgaccggatatcgagtgggatgagcaagcctttaaagatgctgctggtaaactccgaggcaagctcttcatgtggaagaataagggtcagaacgattgggatcatatcaaggagtgtattcgcttctgggcagtagccatggatgtgaagactattctcctggataacatgaccgccatgaccaaccacctgagtccttccgaaatgaacacggagatcgctcgtatctgtacagagctcgcagggatggccgacgagctagggctgcgaatcttcatcttctcccaccttaacccacccaaaggtaaccgtacccacgaggagggtgctgaagtaaaggaaagccagttcactggttcccgagctatgcagcggtggtgtcagcttatgatcggcttcgagcggaacaagcaggctgacggtgaagagaagcacgagagtcggatccgtgtaatcaaggacaggaactacggtaacactggcctagtgttcaccaagtataaccctgagacgggtcgcttggttgagcgtgagggcagttacgacgaggtacctgctgacgatgacaccccaatttgattacgtgatctatgaccttgagggggacggactcttcaatgaggtcacaaggctatggtgtgctgttgcagtagacattccgactggggtagtccggggattccggcccgaggaaatggacgtgttctaccgcatcatcgcccatgcaaagttcgtggtcgggcataacatcctagactacgacaaccgggtccttgagaaacttcatgggatcatcatccctccggatcgaagctacgataccttggttgcatcgaggttgacttggccagaccgaccccagggtcattccctgggtgcctggggtagattcctgaagtgtcacaagggtgatttcaacgacttctccaagttctccgaagaaatgtttgagtattgccttcaggatggagtggtcagtcacgcactgttcaactacctcctccgggtactcggcatgacttggcaagagcttgttgaatggaggactgtagattggctaaaaagcgagtgaggaactacaagcgtgaaagggaactggctattcgacgcggcgaaacgggcgtggggtctaagtctggagatgctcagcggcacagggcccgccgaaaggtggaaaagcgtcttggaaggaagctcggagccgacgaggttgtcgatcatatcaaacgtgttaaagatggtggcggtaacggggattctaatctccgcgtccgtagtcattcttctaacgctgctgatggtggtcgtgtgggcaatcgtaaggccaaaggcattcgtaagaaaaaataactaaggaggggccttcgggcccccgaggactcactatgttcaatcgaaagcttagcatcagcaacatcctcagttccttcgacaaggtgctggttaacctgaagacctttatccaagagtcttcggaggaatctgaacggatctacaacgagatcagtctcctgaaggcggagcgtacccaggtcatgcaggacaacctgaaggcccagaaggtactggctaatctggaagaactgctgggaggtaagagtgaagaagtatcgagttaacgtgggattccaggacaccaaggtgttcaacgcagacttctaccgaatcgagttggatatcatccggttcttcgcgggtgattctgatgccaaccccatgaccgtccgagccaatgaaatcggtgctgtccgtggatgggtttctgtggaggagattaacgatggcgagtaagaaggaaagcctggaggatcaggcacggaaggagattgccctggagaaggagttctctggtagctggggtggccccgagatcgatgctgatgacttccccttgggtagtgcctgtggcctagatcccgaggtatgcgagtcatgtcaatagctctacaagtccttgtcatcttctggagtgcattcttccaggtattcctcctgggattgaactctaagctgctccgggatgacaagatcaaggctgggttcgtagtgtcttggtgtatcacgctggctcagtttgcttacatcaaggctgtagcctcctcccacttggatatcggatggtttatcttcgtgtccgggtggggaggtgcccttgggattacctctgctcaatacttctacaagtggtacgacagggtattccacaagaaggcttgacaaatccagaaaagtgtggtataataaccttaaggtgtccggggttgctttacccctataggagatacaaatgagtgaccatgtaagctattccaaacatgtccgtggcaagtacctgtgtaatatggcctctgccctccataagagcatggagatacaaaggactaacatccggaagttcctcagcagtccccagattactctccgggagaagcgtcgggtattcctgagcctccccgctggattcctgggggtgagctacttctcaggctcccacctgaatctgagttcctactcgcctaaacgcaatagccgggtacgggagaaggatcttagcctgtacgatgacttctacatcgacaggaatacccagctagatccgcgagacctcttgtttacctcccaagaagagaagaaatgggagtttcaatacctgaaggagaagcggggtgatgggttcgagctatccgatgaagaactgagcgacgttaaggatatccagcgcaagcttgacctgtcctggtacctggtggaccttgcctgtgagcgtgggtgttcctacttcattttcgactggtgataacatgagcaagatcaagagtgttctcatggagcgggtagatgacttcctgctcaagcaagttgctgtagcgttcttggaacagcaatggcgactggaccgaagcggaaccgtggactacctctcctacctggagggtatctccgacgaggccgtggaggtagtcatagagaatctggcggagcgtcttaagggggactaagtggattggagaaagtcactgttcgttgagcacaaggtagctgatatcatcagtcgccagagtaaacgtggagtctacttccagactcagcgggccaagtggctgatccatgtgcttaccgaacgaatcctcaagattgaccttgaggccgtcccccagatgccgatgatgatcgtaaaggctggggccttcagcaagccattcctaaagagtggtaagccgaaccaaaggctccagtccttatggcagcgtcttgggcatttcgaagtctctggacccttcactgcaatcgagtacatacccttcgatcttggtaagactgccaagttcaaggattggatgctggatcagggatgggttcctgaccaatggaacatcaaggatattactgtcggcactgatggcaagaagctacgtggatccgaccttaacgagtccttgaacaagtacattgaagacctccgacagagtaaatctggacgactccgaatgaagctccaagggatcatccctgggaagactacgatcggagaggtcaagagaaagttagaaaggcaacgaaaggtattgacgactccgaagatgacggaagagtcgatggataccgtccagggagacctgggaaagctggtgatgcagcgaatggtttgggcccaccggcggtccctcttgcaggggcttgtcgatcaggtgaggcccgatggacgcctagaggggagtgctaacccctgtgcaacacctacgggccgaatgaggcaccgtgtagtagttaatatccccgctgctcgttctccctttggaccagaaatccgagggttgttccaggggacacctgatgccggtgaatggaaatggactgtcctccgccgagacattggagagaacgaaagggttaggcccttcactaacatcgtggaggaactcaagaaaggtaagtggaagcctgtaggaaagcacaagatatacgtcccagcgaatcaaatgatcttcgtgggctatgatggtgctggactagagcttcggatgcttgcatcctacatcaataacccagagtacaccaaagaggtggtcgagggtgatgtacacactgccaaccagatagccgcaggacttccaacccgtgacgatgctaagacgttcatctacgccttcatctacggtgctggggatgccaagatcgggactatcattggaggcaccagggcagacggggctagactccgggcccagttccttgaggctaaccctgaccttgctgcactgattgagagggttaagcaggaagccgagcgaggttatctcgaagggctagacggacggaagctaaccatgcgacgttctgagtctggcgacgtgatgatccataaggcattgaacaccctcctccaagcggcaggtgcaattgtcatgaagtgggccatggtgctcctagatgaacgggtccggaggttgaaccttcgggcttggaaagtcctggatatccatgacgaaggtcagtgggaatgccacccagaggatctcattgcgctacgtggacagatggaaatctgtgtccgggatgctggagtgctccttggggttaactgtcctttggctagtgattccatcgctggtcgctcgtggtatgacacacactgatacatctgggggttgactttcagccccctttgtggtataataccttcttccctacgagaggtttaagatatgtctaagaaagtatcccaacgattcaccttcccggtagcgaagctgatcttcccctacatcgtaactccggacaccgagtacggtgaagtctaccaagtaaccatctgcattccgaccaaagaagaggccgacgatctggtacagcagatggagtccaaggatgcccgactgaagggtaccatcaagtaccaagagcgtgacggcgagtacctgttcaaggtcaagcagaagaagcacgtggattggatgcaagatggtgagcggaagtctgctgtaatgaagccggtggttctgacctcggacaacaagccgtatgatggccccaacccgtggggtggctctactggtgaagttggcatcctgatcgagacccaaaagggcccacgaggcaagggtactatgacggccctgcgactgcgcggtgtacgactccacgagatcgtatccggtggtgacggtgaggacgatccgctgttcggtggtgccttcaccgaggaagagcccgaggatgtattcgacgaggtgttcgatgacgaagacgctcctatctaaggggttggaggatcacgaggcgggggtatgcccacggggctgcccctactgcttaatcgaattcgaaagagtgtggggtgtaagggtggtcagttctacagctgcatctaataataaagtagaggtcgatcctaatggaatcaagccgggtgagccgggcgctaaacttgatagcggcaaggtggatgttggaatcatcttcgaagcgttcccgagggctctatatgcagtggcacaagttgctaacttcggagccagcaagtatagtcgcgggggttggaggtctgtcgagaacggagtccagcgatatgatgctgccttcgggagacacctccttgagcgacacaagggtgaggctttggacccccaaagtaaactaccccaccgataccacgaagtgtggaacgctctagcatccctggaactagtcattcagcaagaggaggactccaatggaacttctgttggatccaagggctaagactgttcctagcaactactctgtaaaaggcgttgatgtagacctggggcttcccccaggctacagcctaacggaggaagctatggacaaggccaaacgtcaagagagtgaatattacgactggaagggctacgaagcactggttaatccggtagtagagcacccagagtatcgagctaagggtgaagcctttgccctccgtgtattctgggaagagaagctcaaagagtctcaggtcgtagaagaggtaacgtaatgattgctggtatcgatggtgacgttcttaggtatgagctaggtcacgtggctatgtcgaaggaacacatcttcgatatccaggtggagaagccatggcctgaagaggaagtccacaagctcgtcgatgagaaagtcgaacaaattatcaaaagggtgaatgcagatgagtgtgaaatctaccttactggccaaggaaattttaggctggagcttgcgaaaatcaagcaatataagggtactcgaatcggtcttgaaaagcctcatcactgggaaaccgtgtcagccagacttaaggacaagtggggagcaatcactttccacggtatcgaggctgatgactggctcgggattcgagggactgaagagggagataactttacagcgtgttctagagacaaggatatccgccaagtcccaggatgctaccattacagttggccctgtggagattcccagccggagttgggaccgtttcaagttgatggtcttggaagggtctccgcttcttggagaatgtatggcgttaaaaagccgcagaagtcatggaagcttgagggcaacggtacggcattcctctacgggcaactccttgttggtgactccgtggataacataccaggcctcccagggacgggaccaaagacagcggcagatttgcttggggagctttctagtgagagagatctcttcgcagcttgcgcttacgcctaccaacagaagtacggagataattggaaagagtaccttctggagaattttcgtctcctctacctcattcgggaccgctcttggcttgatattcagcagtccggtaacgagtatcactgctcactgaagaaacattgggagattccctatgacgatgaagaaatattctattgaggaagcacagaaaatctgtgaaggcctctttgagatccttgagggtcttaactttactgactacaaggtcgctggtggtttccttcgggatgcagacaacggggttgcacccaaggatatcgacctctatgtccgtaggccatacgtggaggaccccactgatactcggcgtagtcgctttggaccacggttgatcccctgtgatgacgataccctagaggtagaggtcactcgattctacaataagataggacacaagaaggtccggtgtaggactggggataagcctgatgggtatcctgcggggtttgatgtgtgggagtccattggtgttgacctacccgtcaacctcgtcgtgactactcactcccacccagcagagttcgatgtaggcctatgtgagatcgcatgttggcctgtaaatcggtttggtttgaagtctcaaatctaccgcacaaaggcttatgagtttgataaggaagagaagtgcattaccctgaaccgtcttctggaccctctcctggatcattctcaacccctaactgacaatcaagttgaaaaggttgtctctcatatccaacgtatcaaactgaagtatccggagttccgggtgtgtctgggggattgggtttggctgctgatccggtctaactctgtcctcactgaggggacgctatcggttgtccgtaagcttcaagaaggagggctcattggcaaagcaggggagattcttcagacccaaactgaagtcattgattgggacgaagtacgacagcgaaaccgagaagatcgtccacgagacgatgccttggatgcagttcaagccggagccggtaccatacgtcatcgagcacaagtacaagccggacttcaaggtatcgacattacaaccctgtggatcgacgaagcatctgctggttgaagtcaaggggtacttccaggaagcctcggaggcatctaagtacatctgggtgagggaggctctccctccagatactgaacttgtgtttatcttcgagcgccctaacacagcttgccattggcttagtaagcgtaaagatggcacaaagcaatccatggcggaatgggccgaacgtaatggcttccgctggtttactctagagactttcaaggagtccttccctaatgagtaagaagtataatgaagacactctcgtcattgcggacacccaagttcgatccgaggtcaacatcgatcacctcgggaaccttggggagtggatcgcacgtaaccgccccaagcgaattgttcatattggggaccattgggacatgcccagtctgtcaagctacgaccgtggtaccgctaagatcgaaggccgtcgagtcctcgctgacatacaagctggtaatgatgcgatgcgagttctgctggatcctcttcgccgcctacagcaacaccaatcgggttgtaagaagcgtatctaccgaccagaaatgcacttcttcatcggaaaccacgaggagcgtatcaagcggtatgaaaactctaaccctgctctccaaggttttattgggtacgatcattttgatctgtccgattggattgtccatgatttcctcgacgtgggtgttatcgaaggtgtcgccttcgcccactacttctacaatcccaacagtggtcggccatacggcgggagtgccgagcatcgcctcaataagatcaagcgcagcttcgtccaaggccatgagcagggattcaagtaccacatcgaggcagtaggcaagaagcgaatccacggattggtagtcggtagcttctatacccacgatgaatcctacaagggtcctcagggtaacgaccattggcgaggcgtagccctcctccggaaccacaaggatggagagtatgacctcaagctgatgagtgtggaggagttcctgtgagtaagttcttgccagacctgtactatattaagtctgagcatgacttcggtcaacgggggttggcgtttaagacgccgatctccgcagaactctggctggatatgaagtttgggaaagggggtgctgaggaggggcttaggcgagggatgtattccatcgaagtcctggagatcctctacatccccagcgttcaccttccggatatcttggggtaatctatgaaagaccgagtaggacgtaaactagaggtgggggacaacgtagtcttcctgatccacaggaacacatcctcccacctagccattggtaccgtcgatgggtttacccccaagatgattcggatcaaatgcccgaccatgagttggactattgacgctgagtatgttctcaggagcagtgacaaggtggtgtactatgacaaaggctgaactggagaaagcacttgaagaggcggagagcgctcttgcgaaggctgaggcgaaggccttttcctttgaagagttggctgaagaagctaaaagacagattgaattcctcgaagggatgctagacctagtagacctcagggcttctgtattctacggagattggaggggttatgcagaacgatcaaaaagttaagggtggattcccctggacctaccttgcggtggcagccttgtttgccctactggtatatgtaggatatagctgactgatgttactcctgaccctgggagaaatatcaagactcctcatcgaagtgttatcttgggcaggttccttatgaagtatcgagtgaagcaagtggggaagttcttcttccctcagtataagcaatggtttcgttggaggaatttcgagcagagaaaacaggggatggggatccactgtgtcagctcgtatctagagtcccttcctgtagtcttcgagaacctacaggatagctgttgcttcatccgggaccacatggacaggatatccgaagatactcctatctaccaccccgtcgagtaaccaaaaaaaaggccccaagggtgttatcccaaggggccttatctttagctccggagagcgttcagtagtgtattgaacttatccacgagtgcctcgtgagtatccgtataggaagccacggggatctcagatatcttatcctggatggaagccgcaatggcttcatataggccactcacttcgctagccttgggtttccagttacctggtttagcctcgctagccttagcacctacctccagaagcttaggcttcccctcaatatcctcccacttcactggctcaaaatctttcgggccaatgacttgtcgaagggtcccatcttcattacgtacagcaatagccttcgattgaataacgaatacactgttgccgtcgttgtcagcgatataacctgccataatctaactcctattaaactgccgatttgaaggtacccacggtaccaccgaaaggatacactcggacagtgcattccccaaattgaccatcagtttccgtctgattacccttagcataccaagccttgtccggagatacagcgaacttgatcttagctgtagacccttggataaagtggaagtgacaacctggggttacatctggaccaagagtcacggtgatatccgtggtcccttgagacatgaagaaccaaccagactgctgcttagtcagggtaatgttctgagtaagctgctgggtgttgacgacattaccaccaaggtgagtagtcacgaggcggggatccaggtagttctgttggagagaaccaatgttcttcacaggaccacgcatgtcatcaaactgctcgataatgtaatccccgatggtaccaccgttttggtcatccgggccaatcacgtgcttaatagccacgtaaacacccaggtgttcccgacgagggtctactcggaattcactaccgaatgcagtaccgcaaggtgcctcaatcatggtctcagagaatagaccaatcacgtggccagggtcacggttaccacccgaggtttccccaggagcgcccacgagggtgttgaccagaacagaggggataacggcctctgaggggttctccgggaaggaggctgtaacgttctctactaccagggctgcgttctccttaactgcataatagtcagggaggaactctgtagcggtaacgatattagtattcacccgaccggcatccgaggtaatctcaatgagatcaccatcggaattacgtcggaagacttttggcacatcaaccacgtaggcacggccaccaggaccagcggcatcagtttctacataagttgccatattacttctccttaaagatccagagcatcttccatcgcttccataccggcaacgaaaggacgtgctggagtttgcttatacaagaacttccagatttcacctgcggatgggtcatccccaaacgaagcgatagttttaccaacagccatagcaccctcagttgcagcaccagctactggacccaatagtacctctgcgggggtagtccctcgacggtaacccgtcagcatgtcgtagatcatagaagcctggagtggcatctgttgcatcactacgtccatcatccgttgttctggactacgggtatcctctcggctagacccaccgaacttagccagttgacgaagctcatcctggagataccccagactcatcatcagaccaagagtgaaggctacacctgcggcacccataccagcgttggtccaggaaccagcgaagtgtgggctcattcgtctacggaacatcggtaggatgatgttaccataggctgctgggtaacccttcaagagggagaacatctgaacgtttccgttgctcatccacataggcttatcagcgaaggtgggatcgaggactacctgatctacaaaccgacgcatggccaaagtcttgacgttgttagccatcaggacttcagatggggtagccggggagatcaacttgagggcatcctgctggctaccgatgttaacccccatttcccgaagctgagcaaccttcagagcaccattggcagaactgaaggggagacctgcggctagatccatcaggttgttctgatagaccctcttggcagtctctgttgcaaagattcggttaacatgggttaggatggacaagccgttaatgaggaactgaccacggatcgtcttttggatagtagagttaaacacctcagcaccaacccgatcagccatcagagaggtagcagaggccagggtgtggttcatatcactcataaaccgaccggtctcagactttggaaccccactgtagatcctacgggctgcttgtcttactacttcacccatggttgggagtacagccccaagggtaggcataacccccgccttagcgaagggtaggctgaactcagttagggtagagaaccctgcgaggggtagtcgggagagcacgagggcacctgacgtaacagccgccagcttcttaaggttggggtctttgatacgaccgtgcataccattgtaggcatccactaggtcatacatccgatccacttcttccttggtaacccgcttaccagcccgttgagcctcagctacagcagaagcaatcttagcgttagccttctctccgttgataccaaaccgttcggtaaaggcaatccggtgggaagccccctcgaagtaatctcggatttcctggagacgcttcttaggagtatcattaagagaatacttattgaggatctcttggggaacggagccaaaggcccgactctcttccagctgaccatacttaggtaccgcatcactttgggcaaaccgtccacgtagagtatctggatcaccctggatacggtaacgtgggtctacttcccaagccccggtctgctggttctgagtaaccaatcgattaacctcaggggcagtgttaccacgagtatcatccgagacttcagccagccagttagttacagcatcttcagcagcttgtcggttctggaagtaaggagtgatatcgttcaggaactctggggattgaaccttctcaggggacagcccaaagggcatatagttggggatagtcccaacagacatgccaccacggttaacagcctcattccttacgtcatccatcaaagaacgtagacgggtagcctcaggggtgttgacaccagcggatgtatcagcgataatcctatcgatctctttggaagacttaccctcaaagatgctatctagttcagagttccacttacctgcctgtagttcctggtcctcaaagatagtcttaccagaggcccgcttaccactcatatcagcacggaaggtctcagagaactcacgagcgataggggaggccttagcgagtggctctaggagcgacgtagcttcgtttcctagggcatcccaagccttcttgaccgtacccctaggttcaaactcagaagccttaggaggtgcctcaggggcgttaggatcaaccacggcagatccagcggagtcctgatgacgacccagggtgtccatccccgaggatacagcaccaccggcagtacccatagcggtaccagtgaatgcagcagtcaggaggttatccatgaactgctcaggggtttgggtctgcccaacggcatcatacgcgatagtgtcctggagggcctgctgggcaccagaggtaacaccttcagccacaccagagactacagcgtgtttaccagcttgggtaactgcttcaatagcagtctgcttgggtagaccggactgtaccagcatatggtatgccccgtctttcccaaggtgcttcaacaggggaccagcgataaccccagcccctgcggtatccagggcagacagaccagcaccacctaggactgcggtccatgggttgctttgatcggggtctagttccttcatctggttactcagggcacctacgttgatacccatggaactcaggaaggaaccaatgagcgctccacccatacgacctggggccccaaagacagagccagccttagcacctgcggcaccaccagcaagtacaggggccatcgaagggagagcctctacaatgttattctttaggaacgaaccgatggatgggatatcttggatatcagcgaaagaccgaacatcgggggttccgtactgtgacgcttcctgagcattctcctcggccatctgtgtgccgtagtctttcaggtagtcactgccagtcaattcaccgagggtagcaatggtgccaccgatgttagactgcatggtatcaaccccgcgaccaatcgcggagctaatagaattagggtcagccggagttactagggcactcaggtctggggcaggctcaggggtagcaggggctacttcttgaggtgcctcttcgataacgtctggctcattcaaagaagccaactcagcggctacgtcgaggcctttgacctcagccagttccgcatcaatagcggctttcagttctggagaaagagccataagtcaccttctatttgctggaaaggaaaataggctcttaagatgtatcctaagatactaaccttcttagtaagtaagtcaaaaggaagaaggaatcttaagagcctataggtctattatactacattttggatactttgtcaagtaccttttatcgggttggggcaggatagtccaaatcagcaccaaaccagttacccgtaggttgcaacttagcagcctcccgctggataatacctacagggttagcccccggattagcccgaagttcattccggacagtctgggcaatagcctgttgggcagtcttactcaacttcttgccacccagtgcttgagagccgttgacttcactcaggatacccagggcgtccttagtagtgacagcttcaccacgggctgccttagctgctgcttggcgtgcctgggcgctaatcttagcggtcttgagacgtacagcagaactaagctgggcattctcttgagacatatcctgaccccgacgagtggtttcagcctgtagctgagcccgctggttagccaggtcctgtccacgctgggttagggcaaggttggctcggccccgagcagcctcctcagtccacctatccagaagaccagtgttcttacgagaggtttccttaagggtgcccttcttgacctccaggtttccttccccgagacgtacatcagcagcatccttagccaccttacgctcaagatccttctccttgatctgacgatcagcagcagcagcagccatcttctgttggttgataccagcctggaggttacgatcaagttgacgctcataagaggcagcgaacatatccccagctttaccagtcttgtctagggccgaagccagaagaccagtaccaatgagagcgtaagatacataacgagacaggtcatcattatccatagtcctcatctgggtcaactcttcgttcacccggttcttaagctcttggggtttaagctctacaccctctctctgggcatcagcttcaactacagcctgggccatttcaggacgacttacagcaccagtacgaagaccctcggctgcaccctgttggatgacctgacgattagcctcctcctcatctgctacagcagcaccagccgcagaggccacctctggagcgatatcaggctcgatagagggttggttaggggttaccccataggacaggagttcagcccccgtagggcctcctgtggcgttctgggctgcacgttggcctacaccctgggcccattggtttgcctcttgagcaacctcgggacccatgttctccacagcctgactagcctgagccatttcttcagcacgagtacgctctgcatccccaagttctcctggggttacagccgcttggataccaacagacactggaccaccaaggatacctgcgatacgacccagggcaccacgaccagtagcttcagccgcaggggccacctcttgggcagcccgagaccaacggtcagggttctctagggcagcctgagcagcccgtcggacacgatcagggattcctgaaccctctacagccagcggcagtttgttccttgcgattcgcgccatgtccagttcattctgagcagcccgaaggatgctagggcgaattggggacccttcataagccatgctggccataggattaacctccaaatagtttacttaggattccggactttggctgctgtccgaaaccgagttcttctgcgctaggaaggattcccattcccgctcccatacctgctgcaacttccgctgcgcctcgttcgcttgctcctctagccccctcgacagaaaagcttggtactgcttctgaagaaggctcacttccttgcccgaggagagccgcgagtgctgctccgcccattgcgccaagagggtttgattgtccactagactctcccgattgcattgtcccaaggtgggtggggcggtaggagccttgacgactcaactgaacccgctcctgcccaccacctatattctgtcctatagcgaacagtttctgagggagggaggccattagaagagaaggccccctaccctaccacctgcgttcataccaacagaagcaccagctggaccaccgaagagagcacccaaggaagcaccaccgagagcacccagggcagacccgaggccaccaccaccgccaccacccgaagaagtagtgacattggttccccccatatcgccggagataagctccttataggcgaggaggtcgttgaggctgacgttattctcataggcccacttctgtagagccccgttgatttcctgctgctcctggttctgaagcatgctaccagcatctacctgcatggcattaccagagccgaggcccttagcaatagccgacaggttacccagggtattcaacctattctggttgtaagcctgctggtcttggaaagccaactgggaggcgttattctgttgactctggagcaatctagcggtagcaataccttctgctacacccgctcgggaactcccatactgaccagcattagtggcccctgctcgcaggtctggacgtaccgtagtgtcgaagtcccattgcatctgctcgttggctgcaccaatggcgttcgccaagccagttttgttgggatcgtaaggaccaaggtaatcagccagagagctaacacctgagctacccaggagagactgaagggcacccccgagaccacccagcccttcgatgccaccaagctggagagcattttggtcagccaccgggtcaaagttcggatcgcccccgtaatttgggtcaaagcccccgttatgtagccaatcactggcacccgagagtagttcattataattaccttgctgatagggtgtagagacagaggtggtcttttgcttcttactaccacccttgtaagcccgagaatctagggcatcctctacatcgaaccccatcagacgctttacattaaattggaggaagttcatctggagttacctcacgatagaaggatacggagtcttcggtgtacccgagtttctctagggtaggcttccagccccgacgaccttcgcattggataaaccgacagttaactcgttgggcgaactgtccgaggaagtcgtctacctccgagtaatctaccggggtttcattcccaggcatcttaccactccagaagaagtgaaggatgttacccaggggtgcttgggacacttgaattacaccagcgtagccactctcttcttggtagaagacataggcctcgtagttaaccaaggagtgaaccaagtgttcgaagtcccaaaacttaccgaggtccgtcctgttgaaggctcgggccagagcagggactacggtaggaagcagatcgatattctcacgagtaatcaaatgaatcatggagtcaccaccagggggaatgtgaatgtacccccgaagactgctccttggggaattccttggattagaacacggccattagctgtgatcttaaacattgcttggttaaccaccccagtctgaatagtagccctgttgagaacatcaaagacttgatccaacggaggtgcgttagggtcagacggaggtggataagtaatagtgctctgcgctgggatgatgctggaataggccgggataaacaactcagcaggaggccaatacgcctggggtagatccaggacagtagccccgttagtgtagttaccaccggacataagcatggttatccatacctcatccttagcagtgttcatcctataggcacaggtacccatcggctgatggttgttctgtggggtaaataggataaaatcccccggcaggtccttgggtttagtacctgcgagtctccattggttatccaagtcgtaatgatagatgccggatactggacctaccactccgggggcaaaatactttacagtccctggcttgagcttcttagggggctccatagagaccccccagtagccgtcagctaggtcattaagagtctgtccaaccctaacgaattcttcattaaggaagggcagcagttcctcctcttcctgtggtggaatcgaagggctgtacttttgactcatcgcatacctgccttcggggccatttcaatagtgtacccattgaagtaccaatccccctccgaagagaagtcgaacttcaaggctatataccggcccacatgtttagtgtcaatcttatagtcctgaccaatccggtatgggtaagggcctttccatcgaataccagaaccttgtacctgagcgttacccacccagatgttacaagtaccgttaccagtaatgtgtggaatgatggcactcactgtcttcatcattcgatcatccccgagatagatatcggatctctcaagggtactgacgaagttctgcccagagaatgtagagttattaccgaagaggaacaacttcttatcctggaaagacgagaagatcatactggactttgctgggttataagagccttcaccccagaccgaagtatcggtatcccaggggttggggtcgtcatcccagaggttagacaccttaggatcgatgatcccgtaggctccactgagaacgttgggaaggtctcggatactccaagtgttttccttccagctccagatgatagccctgtcgcagtgcttacctggctcagacctagtggaagagtagcatacccacatttcagtattcacgtggtctgcaagtacgaaggtccgttgatagttgtcagggttaatatccgagaagaagaacttacggacctgggcatcaataacagactgcttctgcacaccgttgtggacatatacatcaccgtgacctactacaaagtggttaccatcgaactctactgcacagttgggcccaaggatacctacgtcgttaaacaactgctggaactggaagatgaacaatccaccgatataccgcatggagtatacagagtcttccttgtagatgatgaaggagtcacgaagcttcacaccatccacgatagcaccattggtatcagccaaggtgttctgaccagcatccttagtagggtccgttgggtcccaagaggcgggtacaccaccagcatcagccgaggtactccaccagaccatctgtggcatttctacagagttacttgtagcgtttaagccaaccaggaagttcttaaaagacttaagcctcttaaaagtagtattcgctgggaagttaggaagtaccctaaaggttgattctgacggtggaagatgatgaggggggttaaccccatcgttagcaaagattaccccgttgaacgaccctacagaccacctgttagttatactagcagcgtaaggtcctggggatacatcgatgattgtagtcccgtcggctagatacaacctttgttcagaacacaggagccaataggggatgttattccggatgaaaggaaacatatccaagattggggcctgggctgtatcaaagataggcgtatggcccagagccttctgagccttgccgttcttaaaccggacgttgttcccgaaggaccatttctccagtggcaggtcagcgggggcgatatcggtcacaatccccgtagggttcttgacctcttgtctctctagggccattgtatacctcagttcttaatgatgaagaacacagaacagaacggtgggatattacccaacggcatgttgatctttactgcatggttgtgagtctgaccttgaccagcaggaccagtctcaaggttggtattggctgcgttaccagagcctcccgtcagagcacccgagtcacccgcagaaccggtgagggtagtagcacccctagttctccaagtgtgggtgtgtgatgggatttgggctagggtaagggcagtcccttcagtgaacccatcccatacaatgttagcgctaccgcctctagtacctacagcctgggaagatccgtcgataccccaggggaatgcaccaatgaggttggggactgggataccattagaggtagtccctacaccattacaaagcttccaacctgctgggatctgagccagtgacccagcccacatgataaccatcccaggtttaacatactgggttgtatcagcgactgcgtttagctgggctgccgttacagtgacagcctgagaaatattggggaaggtattcttaatagcactcttaatgagtcgcaggtggtcatccccaaaggacttcagatcagagccggtagggttcgtaggcaccaactggttaatataagttgcgacctcaagacccattcttggcctcctttatctcttctttcatttcttttcgggtgacataccgctccccaaagattgccatagaaatctggagatcgctcaccgcttgggtgagcttctccgtggcctggatgtttctttcaagcagagcctgatgaacattctgaccgacaaccgaggaacctaccgtcactaccgaggatacgaccagggcactgacgatgctgcccaggttatcagttagaagttgcatcctccgtcttctccttaaggttgtcttccaggacttttacgaactcgtcgtcaaccttagagttagtcttctccgccagggccttagcaccagtcacgatggacttagcgattaccttggttgggaagagggtagccagaaggttgattgcgagggtttttagaaagataggcatctgaagctccttaacgttcaatgtctttgatcgccagtcgagtgctagcgaagtcagcggcattctcctcgttctggagttccataacagcccgttcgagtttctgaccccagaactgggaccgagcttcatccatggtgtacagataaatctgctcaaggacaccatagagataaatctgcggatacttcgtcagagcccaagtcgttgggttagcgaggcttagctctgggagtacagtccagtagttcacaatgaacggggcaccgtcaggaacaacggggaatactcgccagaagttacccaaccgagtgtagtaggttacaccctgaggttggtagttgtagttaacatagtgggtgaagatatcttgggtgatgtactgaagagtacgcccaccgataagagagtcacccgtgatagaccttagagcaacaaagtgctcagggatctcaatgccaccaccgaaggccatgagggtttcgaagtgttcgttctccctcactcgtagcaatcggttaagacggtcagtagtattcccaatgaacagcatcagaagttcttgggtaaggtcctgacggtcagaccactggatagcggcaatagcgagatcagttacgttgttgatcgtagccattcattacacccgtgcctcagaggtccgcatccgatagttatctcggtcattaagccaacgggtaaatcttgcggcatgatctgggtcacaaccaatcaggttaagatcgatgggaccaccttcagccatggggcgattccgtagtgcctctacgacaaccaaggggatacttgctaccttgcgcatattatccttacggttgctattgacacccgagtggcgctcttcggcgttagcggacaggattgactcaacatcttgagtatcctttcggataaagagcccaaggtcttcgtcaattgcataagtcgattggatactcatgatgtacctcctagggggaaacaaagggccccgaagggccccgttgggttagacctgggctacaacgtctcggatcagagcaccggacttctcgttgtttacacgcagggtgtactcaaccagcagctggcgcttctcgctgtcaccggtcttagccagttcgtgctggaagaacggacgcaggtagcagagagcgtgcatcttcggatcaaagatgaacatggtgttttcgtggaaccagcggttggcacgaatggtgtacttaccgaaatcactctcgtagacgtccacggtctgcgcaatgcggttgtccgaggcatccagggtgatctcagttgcacgacccttcatgttcttgctgatggccttcttgatcgagctagaagtctggatcgagttagcctgaccaccgttgcgccagatagcctcagaggcattcaggagcatgtcttcggtcagaagacggaggtcaccagcggtaccagtgtcggaaccatcaccagttggcagggtaccgttagcacctaccgaaccgttggtcttgtagtaggcaaagatgtttgccatctgacccggagtagtggtgttacgctggatcttagcctgaggggcaccgaccatggcgtattccatgtccagcttcagttccttcgacttcttagccagctgatacgccagttcgttcttacgaccagccttcttgaccttatctgcggtaccggtgacttgcagggtctcgtccgagatttggcagaagttgttcagcatggtggtgaagctaccagccttgatggttgcatcctcaccttccactcgggtgttcttacccggctggcggagttcatcagtctgccactcgtgggtgatagcggtagctacgcccttgccgatagcagtcatgaacggggtgtcatagggtgcgatgttgtagatgatatcgataaggtcttcgcgcttaccgttgatctctacagtcgagacggcattagttggagttgccataagttacgtttccttctattagaaaatatcgagagaggagaagagagcagcagcggcttcaaccgactggtctttcctcagattagcgcgggcagctttaacccgcttagaaccctctgaggcttccgccctacgagcagcaggcttaactgcggcaggtagttcagtctcctccttcttctctagggcagccttgcgacggacctgagattcagcccacttacgtgctgcatcgagtacagccagttggcgggcatcagatatccctcggatctcatcctcggagtatccaatcgatttgccgtaggacacgatcttgtcaccccaagactcatccgtagtcatttccgggataagtttcttggctagctctgtctgacgcttaacgtaggcagagtggacaatctcggctcgcttctcttgcatagccttaatgtcgttacgacgtttgataagagcctgggctcggtctcgggcttccagggcttccagtcgaagggtttgatacttctctggatcctgggccttaagctgctcccagtttacattgtcatactgattagcaccagcgatagcggtaacagcatactgctcaagctcggccagtagattagagcgttcagcatcaagctcttcgaacttagctgcatactgatcctctagttcagcttgtcgagttacgaactcttcattgcgaaggtagccactcttaagctcttcgaagttaacctcgtagacttcatccccaatcgggatctcgaagagtttatcctcaggatcttcctcggactcaacctcgggatcttcctcagaaccctcttcttcctcctcggactcaacctcttcggtgtcctctggagtaccttcgtctactacctcttcctcctcttcttcccctacgactttaccatccacggtttcatcaccgggggccaggaggtcatcacctagcaaatctccgaaggcttccgctgcctcgaattcatccatgccttgattctcaaggtccattacttatactcctttagagtgatcgaatccaggatagcctgaatacgaagttgtacgcggttgagggcatgtagttcgtggtagatggcctccctggattctgaatccttaggtgccgtggacttccactctccctcgatctcttcttggacaatacggaaaagctcaggaagaacgttctcacgtaccatctgttgtgccgcatcagtcagcactagactatagccaaaacgttctcccaagattatttcctcactgccttcgagggcttcttagtctcaggtaccttaccgtctccgatataagcagcccgagcctgagttgcctcaagatgatactccgcttcgttacgagcccgttcccaagtgaaacgatcacgctcaagttgtagttccgcttccttaagggccatttctctctgctgaaggacagcctcttgcttcttcagttcgatctcagccagtcggatctgagcctctacctgcttcatctgggcctccgcttgcttagccatagcgtccgattgggcacgttgggcatcagcttgggctttgatatcttcaggcttaggttgtgcttccttctgctctctgatggccttagcccgttgagcttcaggagaatccgggttagtccagaagcgatccgggtctttgtacccagcgttctctgtgacttccttaaggatattataaaggttctgctcagagacaaggaccccaagaccaccaccccctactacagcctgggccatttcccagatacgcataaggtggagcatctgctggtctttgttcatgtttccgataccaacggtaaccgtcaggtcggatctctctcgccagttggcagggttaatagcaacccacttgcctcgtagctggaagacctcttcctgattctggtacttgatggcatggtcatgcagaagttggaacaaacgcttaacaccagtctctgcaaacatccgggcaatcaggtcaatctgttgctcagcagcagtcatcaactggttaacactcatagccgcttggttagagtgtagggtgttttggtctaggcctcgggtacgatcagtgatgcctgtccgcttacccctatcagcctctagcctatctagcataccgtagacttccccagacagctgaggggtctccagaggcatgatagagttcatggccttaacccgaacgatacccgctgcctcgttggtcagcaagtcttcgaggttaacctggccatccaggactacagatcgcccttggttggtccggtagatattgtccatgatgttgcgcatgagcaccgaacggatctcttgaatgtctcggatcttatcgtagacactcatcccgtggaacttatgggcaattcgataggcattcaggtcagcgaagggacggcaatcccaaggctcgttgctgatgatgtagtcgcccacgtacaggatacggcgcaactcagagataccatccccatctacgtccagaagggtgtagcactcggaggcccatacctcacggttggcttcagcatcatccccagagttgtactggagttggccagtcatatcgaagttatcacgtaccaacctttctggctgactatcagagaattcatactcatcgtatggaagctcatctagtacatcctcgggaacacccaagagcctcaggtcacttacggtatacttctcacggtgacagaggaagcgtgcatcatcaatgcaggtagccaaccgatcaaccaggaagttctcaggcttgatacaggtgactttaatctctcgcttcttcttgtccttgcgaattttaatactgtaggttccatcctcgtccacactctgtgctagaatctcagtgtctggatcagccaggatatccgctaccatttcctcagagagaccagagaatcgttcgaaggtagggttcaggacctcttctacatagacctttacaacaccggtcttcatcatcagagtgtcttggaaccagtcgaacattaccttgaacccctcgttcttacgcatgaagaggtagttcacatactcagtctcttgctctgcctgttcaacatcttcggcagtctgaggttcatacttaactacttgaccgcctgacgtgaataccttcataagagaaggcataatccagtctacagtctcttgaacgtccctagatacaatcgcggacttcccagggcgctcgttaccgaagggctctccgaagtagtacttcagggcctcagaacgctgcttggaaagttccgaagagttgaaatcaagggcgtcgttaacaagttggtctagatgacgaagtacctgttcatcatccataggcttaatcttgcgacgacgcttagccattagacaatactcccaaaccaatcaggggtcaactttgcagtatcactcctgtagtatccactgtttcgtacagcaccaggacgtgcatgccgggaagccatcaacagggcataccgggtagcggatatcatatcgtcgtttctgtcgataatctttccgtcctttcggtggtacattttcatttcttttaggaagttcgtacacgtattaaacaccttcagatcaccattctccatacgggtcaacatccagttaacaccgaactctacagagttacctccgtgtttaccatcaggacccggtgggttactgaagggctcatacactacattgaggttgtggtcatctttaagaaggtctacgaatctacgaccagaggttgctccatcgtgcttaaaggcatcgtgggggacaactaccgggatctggtgaccacccttcaggtagatagcatcagcgtgcatcccaagggtctcaccactctcacttctctcatcatagaggtagtatttgtctttctcagggtcccaggccacacaggcgatagcgttagggtggtcaaacccgaggtcgataccgatgatcctatggaagtgatcggggatctggaaaggctcacatacaaacttctcttccagaatggggaagactacaccagatccgagcataggaacaccctcggccctcatcctgcgttctgctggagagtataccgagagtagctgctctttaacttctggactgaggtgtggagcgtcttcccagcttgcatggacaaggaactgaccaggtttaagatcctggaggaagtccttgacgatctccgtcagaccatgctctggggtaaacgtcagatatacaatacccccagtagtagccgttcgggttacacactgggtataaatatccttggggcattcctcatcgagccagatgacgtcgatggcagtacccatgaatttgtcctgggacatttcgtaggacttgaagataagggacgagaggcccccggaggcatgcttaacaactactgcttgcacacatccgggtttaccttccctacgaatcgtctctacgatatcttccttggggatcatccccgttccaaaagcctcagggttcttccagtcacctagtagttcggactgaagaatatcccgagtggtatccgtggagatccccgccgcccagcagttcactggacgatcatactttctaccagtccaccactcagggtagcgaccggtgaggtggcaggccatgataaaggccccggtgtaggttttaccacagcggttaccagtcatagccagcaactgggcgcagttcgaggaagctgcgataaacttctcttgccacccataaggagtatactggttcatgcggaaatacttctgccgctccgccaactccctgactagattccgtagccgctcttgggtatccattagaccaccttgtcacctactgttgatgcacgccacagggcccgttggaggtcccttacgcgcactggagtttgtttagcccagaggctatcctctgcctcccatgcagcctcatcaaaccttccggatttcagaagattccacgtcttgaggaacttcttcgtccacgctgtacccagctggaaattgacgctaacgagggcatcgaatagctctggagtgcaaaaaggcagctgagatacttgcccttgggctgcatcataggctgccttactatccttctctagccaagtctctgctcgtgctagggtaatcggtccgtcttccccagggagttgcaagtggccataaccaccagttactttcccgagggagtctttgtaccactttagtaccaacccctctcttcgcttgattagatcaaggtacttaagaggctgggaaagaaatgactttagccaactctggctcttcgtcgagaattcgtcgaacttcactgattagatcctctgcggacatatcttccacattcttagtagtaagctccagtttctgcttagctccgaagcctccacgatccaggatatcctgggccgccttgaggcgaatcccacctttctcttctgggttgctagcgatctctacaaccacacgaagcgccatagggacgtgactcccgatgcgctcagagataaaggcgttgatgtattcggcatgctttcgatggtatgcagctacgttgcgttgcgcatgattaggagagaacccagcggctatatatgcttgggttttgttcataccatctgccagagcctcacaatagaggtctagcttttctttagcagaaagaggagcagccccaatcgagacaaccttttcgtctgacatacactgctccgatctctctaatggtcaccccggtaggactcgaacctacgacctcctgtgtccaagacaggcactctaaccaactgagctacgaggagttaatggtggtcgaaggaaggaattgaacctctagcctatggcgtccgggttacagccggatggtagtagccatctacctctacaacgacctttgttggcgacccatgtcggattcgaaccgacggcttctccctagacaggggagcactctaaccgctgagttaatgggccataatggctgggacggtagggctcgaacctacgacctgagagttaacagctccctgctctaccaactgagctacatcccaatgaactcttaaggttaatttctcaaccttataatactattatatcacactttttctattttgtcaagcccctttttcatcttttttttatttttagtcgcaagacccggatttgttagggtttttgctggaatgggaaaggggttcttaagactatcttaagataatcttaggataactaaccttcttagtaagtaagtcaaaaggaagaaggaatcttaagagcctataggtctattatactacattttggataccttgtcaagtactttttgatatttctttgataatcacatgatttacccgacgaacggtatgatagggttctataggtataccctaagactacccttcgtaggttgctggtaaggggtaagtggcataaggttcccttgatccaggttctataggtatacctctagactacctctgtttgctatgtcctggcctattgcccctttatccagtaatataccaacaggtatcgaagggtgctttgatccagggcctataaccgggggttaccccaaaagtctattttatcctccggtgtatctggggaatatccccccagagtcccccaggataacgttggggtggcctatccccaggggtatagcccctagcccctccctaggataccataaggctagtccgggggtcaaccccttgagataccgttcatcgggtggaccctagggtattcataagaaaaatcttagggtattcagggggtggatcggggggaat

SEQ ID NO: 12 - DNA, 44662 bp, Podoviridae Bruynoghevirus
  misc_feature (1)..(44662)
  misc_feature (17448)..(17448): n is a, c, g, or t
cccccaggagtcccccagataaagtgggggtggcctatccccaggggtactagcccctagggcctccctaggataccataaggctagtccgggggtcaacccctagggataccgttcatcgggtggacccaagggtattcataagaaaaatcttagggtattcaggggggtggatcgggggggaatatcccttgatcccccattgacatcccacgataccctatgttaatcaaagactgtctatatccggggggtttgctgggggactgatagtccatagactgtatgaaaaaccagtagacaaccccgtaaagaatatggcgtaatggcgccgccttgagggaaaccgacaggcaccgggggaaaccccaggggcttgacaaaccccgcggaaccgggtctaatggcccccacgttctacctcggccaccatcccccttgccgcagtgctatccgggggctgccaaccagggaagagcgcccaagtcgcccaagtgtaaagccggcaggtatcgggggttgacaagggatcggtgaagcggtatagttcgccccacgtcaacggcataacgtgcatgactccctcgggattagcgtagccttgacaagcaagactgatggccactcagcaaaagagcctatgccggagaactggacgaactaacccccgtcagagggttgacaaggcaagcccaagcctctaacatgggcacccatcaggtgacggccacctggggaaagtgtaccctcgacggtccttggactgaacaggggagaaacccgaaagctgagggaatagcgcatactccgattagagcgctggctttgatggtcgctgccttatgacccatccgactggttgcctgctccagcgtaaacaattagcagagtccatggtggaatcgtgatggacagtatgttgggttagtatcaatggcttagcgcagagggcgaagcttggtagatactggcgaaggtagggacgagtagacacgaagactcccgaggatagccagaggacagaccataacagcgatactaacgcggaaaggggccggctacgccaatgccaaggtttgccgactaacccctttatcgtatcgggatgcgtgtcccggctgatgattccaaaaggatgaaacgatgaacgctgctatcgataagaagctgcgccgcaaggctagccgtaaggctcgtgctcagggtattaacgttgggcaccttggcaaagctcagcagcgggcagaacagaagttcgggatcatttccagttgtaacaagatcctggacagtaagtatgtttcccttcaggaaaaggctggagcacgcaagcgaaaggctctgatgaataccgattggcgtaaccgtgaggatactaagctgcgcaattggtacaagcctagcaagtgcaagaactcccctgtaacccacatcaaacccgaggtataagttatgagcgactacaagcgtatcaatgggatcatcaagaccatcgcccagcgtggtgcatccctggacaagctgattcaaactaccggcctggacattctcaagcacatcgacgagcatggtgaagtctcgttggcatgcaagctgttcaaggccatgcccaagggctcccgtcgcaacgctctggccgcgtggttcatcgatcacggcaagatcaaggctcagtcggacaagaacaagtcggccgagttccccttcgtgtacgacggcagcaaggctactaacctggagcgtgccaccgaaaagccgtggttcggataccgcaaggaacgtgacgttgccgacgagttctccctcgacgcggccatcgctgccttccgtgccaagatccaacgcgccatcgacaagggccaactggaagagcacgacgagcgtatcgtgcagatcaaggcgctgaagttcgaagagcctacgaaggcagcgtaacggccagggccaggggtgtgtactatgacgcgccccttggttcctccctagagtacatggtaggtccgtgtattgtatggatgaactaaccgaggataaaaccgtgtggaccccttttggtagctttctggtagctgttacaaacgactacgtgcaagggcgttgtaactcccgttcgtataacagtgatggtacggagcaggtagtgtaccgttgggctttcgtcgatggtaaattcgcctgcggtgtctatgtagaaggccgtcccatgggcttctgcgggtggaccaaatgaagtccccctatgaagccgcccacgaaagggcactcatggttaatcggttgcagaagctcactaggatgcttcgggtccatcccgatcccaagtggaagcaagaacagcaagaattgattaagaggttgaagcgatgactattgctatcgtggtgtcttgcgtaggcatcggatacttcttcttccgtgactggaaggaagagatgggtatcaactgacccaactgatgaggccatggtgattcctggccgaaacccccaccggacctatggtcgcaggctggggagtcttgggaaatcaacaaaggaaactatcccgtgaaacgcaacgactatcgtaaggtcagccgcaacatgcaagccatcgaggctatcgaccgcaagatcgccaaggtagctcgtgagcttaccaataccaatggtagccaccttggtaaaaccctggagcttaacaagcttcgtgcaaagcgtgcatctttggctaagaacagggcgcggtgatggcatggaagtatattgcatgtgccgccatacgctcacgttccaatgggttgttgctggtagcgtgggtggttctcttcgtcctgtcctcgaccttggacagcatcccttttgcatcgtgaggtagtcctatggatatcaaggtgtggccacgcaacggagtaaccctcagttctctggttaagtcccaaacctttctcatcaatggggatgtgtacatggtctgcgaactccgaagcatcaagatgaagagtgaatctgacgaggttcccgttctcaatctcaagactggcaacgtcatttacatgcctccggtgagcctggtatacccagtaactgccgagctgaattgctacgaggtgtaacatgatggttaagtacaaccaactcaccactaaggtaaaaatcctctcttgggaggagctggaatctggctgcctctacatgcgggtagatgaggatgggcaagatagcccccgaatcttcatgttcatggagtatgccgacgaatggttcctctttgatatcttcggcggcccctatggtgatgtatattacagcggtgacgttgagtgtgggttctacccggtcaccatcgagggcatccaagccactgtccatcggttcggccctccggcctagggtgtgtactatgacgcccgcccaatacatctacctctggttggtatccaaggttgtcatccgtcgataccagcctaaccccaaactgtaccccaactggtccgttactcatatccgtgtgtcgatcttcggcaaacgtgcaggtatcgtctatgaaatccactgaaccacaagtctattggttggccagtcccgatggtgaattccacctgaaggtcatcaacttcggccagttcatcaccgaaaccctttacgaactcggcattccggtggaccacaaggttcatcgggtccactgaggtgacccatgactactttcaccataacggcaacccaacctcggaatgacttgcacatcagcaagcgggaggatggtgtgtatgtaaaccagcgggaaactggaaccgtggtatacctcaagcaaggtgacatggtgacggtcctcaccagcagtggcttctccatcttcgagtcagacaggatcgtgggtcatggggaactattcccggctaagtacgttcatgtctccgccaggatgtggggtccgtatgaggaataaaccaatgatcggccaaatcatggcccaggagcgccgcatgaagcgtcgagtagagaaacgagggttcaacatgacccatcaggaaagcccccaggagccccgtggtgagcttggtttcaccttggctgccgtaggtatggagtccagccgatcggcttacctgcggcacgccagggaggccatgatccaatccggggagccttgcccccattgcatgccagtcttcggtcccaaagagggtcgttgctgcaactgcgcgagggattggtgatgacaactccagaaatcctcatggtgtccgccgttaccttcttcgggttggcggcctacgggctcacatcctgcctgatctatgcggtattggaagagtgtgggatgaggtgggggtcagatcgtgattgggcagtcctcctgtccttcttctggcccctgtctttgcctgggatgatcctgtacttcgcctgctacaggcccctcaaggaagtcttcatatcagccaagcggctcttcagcggccactacaggaggatctaatggaaagtgtaatcgtctatgcggcggcggccttcttcctcatgatgtgctgcttcatctacttcctcgtggcagccgtaggagtgtgcatgaccttggctctcttcgaggatagtggaaggatcaaggaagagcacgccattgtcattggtgtattgtggcccttgtcactcccattgatctccttcggcttgatggtctactacctcctcttcccgatgaaactcttcatcacctccctctacaaaattatcaaaggagattactaatgcaccgcagagactttccttcctgctgtaccgcaaaaatctacatcggcatgggaccctctggtaccgctgaccactacgccggcctcgcatccaacgggttcagcccccgtggtttcgccaaggaactgatcggcgctatccgtcgtgagtccaacgagggacacggtacgatggttttcaccgtgaacagcgagcaggtagtagccgacaccatcctccgccgcatgggcagccactacaacccctgggcatccagcgacaaccactcgaccaaggtccgggtccacgtcatcaacgtgaagtctgcggcagatatcctcatcaaccatggggttctccgtcgtcacctcggtggattgcaggactacccaggtaccgtcgagcactcggagtacctcgacaagctctgtaaaggtctgtaacatctagtccttgacattctgctggaagtgtggtataataaccttaaggtgccgggggttgctttatatccctaaggtacctaaggttctaccttctatcttcttcatcttaagaaagaggtaagaacaatggtcctcaagctttacactcgggtaatgctcctggctatccccgcatggataagcaccctctgggtagtaccccagatgctgtccccggctaacaccctgatgaacgccatgggtgccggcctcctggtcctttccatcctgtactccctctgggttgctagccacatggcttcctactccaagaagctctcaggtaaacgggtggaggtctgatgtactatgacggaacagatgcgaggccgcctccgtgaggcaatccaaaaggatttagagggcatcggagaagatacctctgacctctacgacaacatacataagatagacggcctgctgggccacccaggtaagcccccgcatgattggggcttctatgtactgatgttcgtcatgttcatcgcattgtgcatggtatacatcactccccttctctacaagtaaggaatccatatgaagaaaatcctcggcctcctggccattgctgctctcgcaatcaccgcaggttgctccaaggttcccgctggctaactcaaccaaggagaaaacaaatggcccgtatcaagtatgccttcggtatgaaatccaagaagggcggggttaaggccctcaaggtaatgacctctgcctcctgcttcggagccatggagggggtggtaacccacggttataagctcgacggttggaccttcgtctgctcccgtcgcagcaagaagttcatcgatgcactcaataagtgtacccaaggtgaactcaagaccatcaccatcggcggaaaggcctacaagatcccgaaggttcacttctggtcttacgaaagcaaggccaagacttccccgttcgtgaagtacgttagcgggtcggagttgatctctcccactcaacacgggaaggaaggggtttgcggtatctacttcaacccgaaggaacataccctggattcctggtaccccatcatgaagttcctcttcaagctggtatccagtggtctagaccctcaaggtcgagaggagaagattcacatggagcttgctgaaaagtatggcttctggaagtcctacctcgcaatgtctttccacggattggtagccaacggatacaccgggtatcccctcaccaactacatgttcagtagtgattgggaggatatcaagaaaggcgatatccacatccagtccgcagaagagtgcaaccgattcggacgttgggtggccaaccgtaatgccccaggtggacgtgagtgggtaaggtgcaagcccgacaagtcagaatgcctggggattaagctgaacaaggtggaggtggtaactatttacccccagccaaccatcttcggcaagaaaaccccctacgacaccgtggatacggaactgggaggattcctccggcttactccttctgactgtgaaaaacacggagtggtaaagctggggatcatgggtgagattggctggagtcgtgacataaaggatatctcactggccctcgaagacttcatcgagaaaaacttctgacaaccaaggagaaatcaaatgggaatgtatgcagcccataatgtgtactatgacgccgagggctctgttgtacaccaatactcggtcaagagtatggccgaatatacaaactgcttcggggcctattgcgaccggacctccgacgttgggggcgaccggtgggttaccggggttggccacctgttggtatctacccacgagaatacctctggtaaactggtggagttcctgaacagtgatttggtcaacaggatcaccgacggtggtatcctctcggcttccatcgactggcctacccgttggtgggattacaacgatgacctcaagaacctcagtgatcccgaccacttctctcccccaggacgccggcaggcagtgtacgttcgggttgatctcaggaagaacgcatcgtccatcatctgtgccctccgaatgggcgatcgtctgtggtgcgtaggtgattccatgcgtcgcatcacccaggaaagccgtgataagatcctgggatgcaatgcagagatcctcaccctcgcggcttgtgcccaggtaggcagcactgctcattgcgacagctatccggcgatgttcccggtgactgctggtgaataccgggaaggatgcgagagtcacggatgggaagtggatgacagctacatcagcgaagtcatggatggtatcgtaggtgggtacaagaagatcacctacttcgatatcaagagcatccatgggcggactcgcgaagagttcaaggacaagctcaagcatcacgacgctgagttgtggcaagggtataccaaggacgattacctgatcgaatacgacgggctcgaaggtgtacacaatgatcggatcctctccatcatggcacccatcactatcgacgtaggtgacccaggtcgggaaaggtctgagaccgtacccaccagtccctacagcatccccgaaatcctcgaaaaactggagaacatgcaatgaacaacgcaatccccctgatcggtgcagatcccgaagttttcgtcggctacgaccgtaacccccagagcgtcatcggcttcatcggtggaaccaaggaagcgcccttggctgtagccggtggtgccgtccaagaagacaacgttcttctggagtacaacatcgacccggccagcaccaaggaagagttcgtcaagcggatcatttccgttcgactcctgggtgcacagatgctccaccccttcggcatgaacatcatcgagaacctgtcgtctcacctgtacgacgaggaactcctccgcagcttcggtccccaggcttacgtcttcggttgcgagccggactacaactgctggactcgtcgccagaacgtgatgccgaaggatgcacctccgacccttcgcactgctggcggccacgtccatatcggcttcagccacatcgagcgagttaccaaggcgaacacccgcgaggtcatgcagatgtgtgactacctcctgggcctggcctctgtcatcctcgatggtgacacccagcgtaagaagctgtacggcaaggctggcgcaatgcgctataagccctacggcggagagtaccgtagcctgtcgaacttctggatcttctctgtcgatctgaccgagtgggtctacgaaatggcagtgcaagcctacacctccaagcacctcctggaggagtacaagtcgatcgtacccggtgatgaagtccagcggatcatcaacgagaacgacggcgctgcggcagttgctgccctccaagccctgggggtgaagtatgaatgacctgaacaatcgccatcggttggccggggacttcaacatgtactactcctccacctatgccttcttccgggtggacggcgagcctcgggtagtgtacgtggacgataccgagtccattggtgacgaccgtcaattcgacgggtttcgtctccttggcaatgtgtatcgacccgatggcagtaactactacggaggggttgtctacagcgatgtagaaagcgtgcggccctccagtgggtactatgacgtctttggtcgtggggttcgtgatacctatgtatcattcctcgtgaacaaccggactcagcgcaagggtgtagatccccggaacatcttgctgaaccatggccaacaggctatcaccggcgaaatgatgatccgaatcttcacccaggccgaggaaatgatctctgctccctcccaccgggatttcttcatcaaggatggggtagttcactggaagggggtgaaggttggtcagatggtagatggccgactgtccgcagatgaacaattcaagaaccaggaggacttgctatgtcagttattggcacacagatagggttccgtaaggaccagatcatcgccccggaacaccacgaggaacttcctgcggttgcttccttcgggttcgaagtcgaactggaaggcctcaacaactggccagaagtggatgggtgggatctgaagggtgacggttctctgcgggagggtatggagtatgtcttctccggtcctgcctctggccagagggcaatcactcgggttgaatcctttgtaagtgcgatggaagaaacccctccggctcctaccttccgttgctccacccacctgcacatggatatgcgggacgtagagtggccggtgtacgaacgaacggtcctgacttacatggcattcgaggatgttttcttcgatcactgccagccgtatcgtcgggatagtaacttctgcatcccgttcttcagcaacgactggttggcccagaccttcggtcgccgtatcctggccccggaaggtgaccgagagaaagtcttgggtcttacctcctggcccaagtattcggccttgaacctccaggtaacacacaacttcggatccatcgagttccgtggtgctcacgccctgactactcgccaggaaatggtaggcctgatgcagcgtatgttgtgtctaaaggctttcgccatggctcacgcagaaactcccctggaagagttcctaaaggttctctccgaggtgaatctccgtgatgtgttcttcctgggggtatctccggactatgaaatgtctccgggtggtcgtgaaatggggatcgccagtgctactctcgcggtagcaaccatgggctttgttcgctccggggtagatcctctggaagatgaacagaaccgtcagcgccgtctccgggagcaggaacgtgagcgtcagcgggctttgggtcataggctgcttgtggctcgatctactacctccagactactcgacggtgcagcagagcggtacaacttggcaatggtcccaggtacccaggttcgactggatacggcgattactgcggtaacttctctgcgtcgtattggtcaccaagtgcgtgtacgagaccttctggaggaccaagaggctcttcaagatgccttcgtactgctcatggataacccgcagcaccttcagcgccatgccggcgtaacaatcgaaccagatatgtactaaggagaaatacaatgtgtggattggtaggcttctgtgccacaactaacgcgagtgataacgaaatcgctcttctcaaatccctcctggccgtggatattatccgtggtgctcacgccaccggtttggccaagatcgacccggttaagaacgaggtaggaattcacaagcgggcagtagatgcctacgacttcctggctgatcctgaaaccaaggagttcctggacaagggtagggctcgcatctacatgggtcacaaccgttacgccacgatgggcgacaagacggaccatggtaatgcccaccccttccaggtagaccacatcaccatggtacataacggaaccgtagatacctggggcctgcacctgctggacggcaatgataagtacaacgtggactccaacatgctgtgcgctaccattgccaaccacggtgccaagaagacgttcgaggagaagttctctggtgctgctgcggttgtctggtgggattccaaggaacgtagcctgaacttcatccgtaacgaggatcgtcctctgttcatggcggttaccaccaccgggaccatcgtatgggcatcggagcctgggatgctcaaggttttcctggagcgacccaatgctaagatccgcctgcgttctcctatcgctgaactgaaggccgaagtcctggtaactatcccgttcacggaggccggagtgcgaaagggtgcagaaccccagaccactccggtcacgtttctggacctcccgattcccgaaagcgaaaggcaaacagcggcatggtggagtcgctacatcggtgtctcggactacgatgactacagccgaagccaaggcagccaagcgggaacgaaaggcagccaagcgggctcgtcgtatggaacgactggcgatgcgtacgcaaggaacaccctccggatcaacaacaacctcgacgcagcaggtagcaccttcaagcaccggcagcttgtcaccttcgatgttgtcaagatcgaggcctacgcaaacggcagcgaatacggaactgtcactggaatcgagcgtgaagaaaaccttctcatcgaagctcatggcatcaacgtctccaaagtccacggctacaccgtcctccgaggaagtatctccaatgcctacttcatcggccaagaccgtgatctcaaggttactgtcgaggatctggcggtaagctgcctggacccaaagcatcggccgactcctggggagactaccccagtgttgaggattggaacgatctcatcggagacgaaatcccattctaaacccagggttcaagtcggcggcacctcggggaacacctctccggccaacatcacctaccccctgaaggtgcaaggccacaccttcaacaacgtgcatgtctttcgggacttcgtgtcccagggatgtgcatcttgcgggaagatcccaaccgcatatgaccagcgtaatcgtcatctgacggtgtacgagggtgccaagttcactggtagcctggatgagtgcgagttcatctgtggtgagtgtgtaatcgaaaataaataggaggtcaaaatgacccaagtaacgatgaagcgtcaagtagtgatccagatggagaccgacgcaacccgtaagtatcccttctcccgtgacaccctggacaagatccagtcgattcgtcgagtcaaggagcaggaactcaatgatgccaacccggacgaggaattcctggtaccggccccggtagtcattgcggaagctatcgaccgactcttcgaagactacttcgagtaaggtagtgcgttagtaatagcccctggccgacccatgccggttcctaagatgtgtacatgggatctgacttaggaattcaggggttattgctggcttcactaccctcaacagaaacaggagatttgccatgttctatatctataaaggtgcccgcccctctgctggtgctgtcgctcttcgtaacgccctgggtgctcgaatccttcgctccgagggatctacctaccgtggccgtgcgggtactgcggtaatcaactggggtaccgtaggtgcagaggcacgacgcctccagggtatcgccccggtcttcctcaatgacccggccatggttgctcgctgcaccaacaagctggacttcttccgccacttcgaggccaacgccccacatctgatcccccgctggacggattcctgggccaatgtacacccgatcctggcctcctgtggtcggatgtacgctcgtaccgacctcaatggtcatagcggcaggggtattcatctgatctgtagcatcaacgacgtagaggtgcaggccattgatgcccttcgtcgccagggtaactacccggtacacatctggggtcatacccacattccggaggtcgtcgagaacgcccaactgttcacccagggcatcgtcggtaagcgtaccgagttccgagtccacatgatccgtggggaagttgccctgctccaggtcaagctccgccgtgttgccaacgatatggtgaccaacgaaggccaaagcatcgtacgtaacgtagcgggcggctgggtctatggcgtcaacgatgcaatggatcgggatggtgctgagcaggctatgtcggcggcggcagaagctatccaagttgcaggcctggacttcggtgcagtagatatcatcttccagcacgctactagccgggcgtttgtcctggaaatcaacaccgcgccgggcctggatgcagaaggcagcgccctggaggcctacgtcaagggcttcaacaaaatcttcgaggagactatctaatggctgttcgtgttttcgtttatggtactctcctgtctggtttgtacaaccactaccttctggaaggggccgagtttgtcggcaatgctgtatcctgcgagcggggtctgatgtactccgctggcggcttccccatcctctccttcgcctcccgtgctgatctcattgtaggggaaatctggcaactccccgaaggtgagaagggggaggaaatgctggagaacttggatgccctggagggttatcctggttggtatgatcgtaccctcaaggatttccggatcaacggggaacgaatcaaggccctggtgtaccatcaggatagccacatggcgatggatatcgtccaagatggcgactggaaggcacacctggcaaaacgacaaggagcagtataatgaatgaaatgaccgtagacaaagcagtagaagtctaccgcgataccccgaacaccttcggacaccaagagctacatgcccagaagatgctcctcaaggagatcctgggacttgtcgcctcccaacgacacctccaagactccatcgaggtctccaagattccggaggcctcggatagtcccgagaccagctatggtgggtactgtgacgagtctgttggtattcgcttcatgtgggagcgactgaagaagatcgaggatcgactccgtgaactggagaaggtctacggtactttcgtaacaactccttacaagaccctgccgggtaacgtcaatgctgtacctagcttggtgctcaagagccagatggaggaataagtgaagcagattatcggtgatacggcttgtccgggttgccgagctaaaggtggggataaaacaggtaatcacctcatcttgttcgtagacaaggagaaaggtacccgcttcggtagttgtaaccgttgcggccactatgaagttctcgaagaaggattcaaggttcctgaacgaagggagaaatccgaggaggatatcatccatgaagtcaacgaagtccttgagtatccaactaaagccctcgatactcggaagatcagcaaatcaatcgctgaacgatacggggtacgtgttggtctatcacaagaaaacggtgaggacgttatcgagcattactatccacgcacccgcgatggggagtaccgagcgtttaacgtccgaatcctagaccccaaggctttctactatcgtggtagccccaagggcggtgtagaccccttcgggtataatacccttcggcataaggatatgggacacctgcggttagtcatctgcgaggatgaactgtcggcaatgtctgtggctcagatcatggagtcgaagctgcccgagaagtggaagcatctgcgtcaggcagccattagctggtcctctggtgttggttccgctggacgagatatcgcattcctaaaggaatctggtgtactcgaacggttcaacgaggtcatctattgccatgatgctgatgacgagggtcgtaagtcagtagagaaggtacgtgccctgtaccccgagtgtaagtttgtagagcttcccctgaaggatgctaacgacatgcttatgcgtaatcggggggatgaggtctaccagatgatccgattcggtagcaaggttaagtctccggactgttccgtaactgtcgatgaggtatacgctgaggcgctagaaccccctaagtggggtaagagctatccctgggaaggtctaactaaccttacctacggtcagcgtgatggtgagatcatcggggtaggtgggggtactggcatcggtaagaccctgttggcccacgagattgctgcctggaattgcattgagcacggggagaacgtagggacattcctgttggaagagcaggtagccatgacactgaagaatatcgcggggaaggtagctaatgttcccttccaccgaccggatatcgagtgggatgagcaagcctttaaagatgctgcgggtaaactccgtggcaagctcttcatgtggaagaataagggtcagaacgattgggaccatatcaaggaatgtattcgcttctgggcagtagccatggatgtgaagactatcctgctggataacatgaccgccatgaccaaccaccttagtccttccgaaatgaacacggagattgctcgtatctgtacagagctcgcagggatggccgacgagctaggactgcggatcttcatcttctcccatcttaacccacccaaaggtaaccgtacccacgaggagggtgctgaagtaaaggaaagccagttcactggttcccgagctatgcagcggtggtgtcagcttatgatcggcttcgagcggaacaagcaggctgacggtgaagagaagcacgagagtcgaatccgtgtaatcaaggacaggaactacggtaacactggcctagtgttcaccaagtataaccctgagacgggtcgattggttgagcgtgagggcagttacgacgaggtacctgctgacgatgacaccccaatttgattacgtgatctatgaccttgagggggacggactcttcaatgaggtcacaaggctatggtgcgctgttgcagtagacattccgactggggtagtccggggattccggcccgaggaaatggatgtgttctacaggatcatcgcccatgcaaagttcgtagtcggtcacaacatccttgactacgacaaccgggtccttgagaaactccatgggattatcatacccccagatcgaagctatgacaccttggttgcatcgaggttgacttggccagataggccccagggtcattccctgggagcctggggtaagttcctgaagtgtcacaagggtgacttcaacgacttctccaagttctcagaggaaatgtttgagtattgccttcaggatggagtggtcagtcacgcactgttcaactacctcctccgggtactcggcatgacttggcaagagcttgttgaatggaggactgtagattggctaaaaagcgagtgaggaactacaagcgtgaaagggaactggctattcgacgcggcgaaacgggcgtggggtctaagtctggagatgctcagcggcacagggcccgccgaaaggtggaaaagcgtcttggaaggaagctcggagccgacgaggttgtcgatcatatcaaacgtgttaaagatggtggcggtaacggggattctaatctccgcgtccgtagtcattcttctaacgctgctgatggtggtcgtgtgggcaatcgtaaggccaaaggcattcgtaagaaaaaataactaaggaggggccttcgggcccccgaggactctctatgtttaaccgaaagcttagcatcagtaacatcctcagttccttcgacaaggttctggtgaacctgaagaccttcatccaagagtcttcggaggagtctgagcgcatctacaacgagatcagcctgctcaaagctgagcgtacccaggtcatgcaggacaacctgaaggcccagaaggtactggctaatctcgaagagcttctgggaggtaagaatgaagaagtatcgggttaacgtggggttccaggacaccaaggtgttcactgcggacttctatcgaatcgagttggatatcattcggttcttcctgggtgattccgatgccaatccaatgaccgtacgggccaacgaggttggggctgtccgtggatgggtttctgtggaggagattaacgatggcgagtaagaaggaaagcctggaggatcaggcacggaaggagattgccctggagaaggagttctctggtagctggggtggccccgagatcgatgctgatgacttccccttgggtagtgcctgtggcctagatcccgaggtatgcgagtcatgtcaatagctctacaagtccttgtcatcttctggagtgcatttttccaggtattcctcctgggattgaactctaagctgctccgggatgacaagatcaaggctgggttcgtagtgtcttggtgtatcacgctggctcaatttgcttacatcaaggcggtagcctcctcccacttggatatcggatggtttatcttcgtgtccgggtggggaggtgctattgggattacctctgctcaatacttctacaagtggtatgacagagttttccacagatagtcttgacaaatccagcaaagtgtgatataataaccttaaggtgccgggggttgctttacccctataggagatacaaatgagtgaccatgtaagctactccaaacatgtccgtggtaagtacctgtgtaatatggcttctgccctacataagggtatggaggtacaaaggactaacatccgtaagttcctcagcagtccccacattaccctacgggagaagcgtcgggtgttcctgagcctgccagagggattcctgggggntgagctacttcacaggctctcatctgaacctgagttcctactcggatcgtcgaaacgcccggattcgtgacaaggatatgagcctctacgttgacttctacgtggacaggggcgcccagctggatcctcgggataccctggttgtctcccaagaggagaagaaatgggagtttcaattcatgaaggagaagtggggtagtgaattcaagctatccgatgaagaactgagcgacattaaggatatccagcgcaagatcgacctgtcctggtacctggtagacctggcctgtgagcgtgggtgttcctacttcattttcgactggtgattacatgagcaagatcaagagtattctcatggagcggatagatgacttcctgctcaaacaagttgctgtagccttcctggagcagcaatggaagttggaccgcagtggtaccgtggactacctctcctacctggagggtgtatcccacgaagctgtggagacagttgtagagaatctggcggagcgtcttaagggggattaagtggattggagaaagtcactgttcgttgagcacaaggtagctgatatcatcagccgccagagtaaacgtggagtctacttccagactcagcgggccaagtggctgatccatgtgcttagcgaacgaatcctcaagattgaccttgaggccgtcccccagatgccgatgatgatcgtaaaggctggggccttcagcaagccattcctaaagagtggtaagccgaaccaaaggctccagtccttatggcaacgtcttgggcacttcgaggtatctggtcccttctctgcaatcgagtatgtacccttcgaccttggtaagactgccaagttcaaggactggatgctggatcagggatggatacctgaccaatggaacatcaaggatattactgtcggcactgatggcaagaagctacgtggatctgaccttaatgaatccttgaataagtacattgaggatctccgacagagcaaatctggacgactccgaatgaagctccaggggatcatccctgggaaaactaccattggggaagtcaagagaaagctcgaaaagcaacgtaaggtcctaacgactccgaagatgactgaagagtcgatggataccgtccagggggacctgggcaagctggtgatgcagcgaatggtttgggcccaccgtcggtccctcttgcaggggctggtagatcaggtgaggcctgatggacgcctagaggggagtgctaacccctgtgcaacacctacgggccgcatgaggcaccgtgtagtagtcaatatccccgctgctcgttctcctttcggacctgaaatccgtgggttgttccaggggacacctgaggctggtgaatggaaatggactgtcctccgccgtgatcttggggagaacgaaagggttaggcccttcactaacatcgtggaggaactcaagaagggtaagtggaaaactgtaggaaagtaccgggtatacgtcccagcgaatcaattggtattcgtgggctacgatggtgctggtctagagcttcggatgcttgcatcctacatcaacaacccagagtacaccaaagaggtggtcgagggtgatgtacacacggccaaccagatagccgcaggtctcccaacccgtgacgatgctaagacgttcatctacgccttcatctacggtgctggggatgccaagattgggactattattgggggcacaagggcagatggggctaggctccgggcccagttccttgaggctaaccctgaccttgctgcattgatcgagagggttaagcaggaagccgagagaggttatctcgaagggctagacggacgaaagctaaccatgcgacgttctgagtctggcgacgtgatgatccataaggcattgaacaccctcctgcaagcagcaggtgctattgtcatgaagtgggcaatggtactcctggatgagcgagtccgcaggttaaacctgagggcttggaaagtcttggatatccacgacgaaggccagtgggaatgccacccagaggacctcaaggcgctacgtgagcagatggaaatctgtgtccgggatgctggggaactcctcggggttaactgtcctttggctagtgattctatcgctggtcgctcatggtatgacacacactgatacatctgggggttgactttcagctccctttgtggtataataccttcttccctacgagaggtttaagatatgtctaagaaagtttcccaacgattcaccttcccggtagcgaagctgatcttcccctacatcgtaactccggataccgagtacggtgaggtctaccaagtaaccatctgcattccgaccaaggaagaggccgacaagctggtacagcagatggaatccaaagatgcccgactgaagggtaccatcaagtaccaagagcgtgacggcgagtacctgttcaaggtcaagcagaagaagcacgtggactggatgcaagatggtgagcggaagtctgctgtaatgaagccggtggttctgacctcggacaacaagccatatgatggccccaacccgtggggtggctctactggcgaggttggtatcctgatcgagactcagaagggtcctcggggtaagggtactatgacggccctgcgactgcgcggtgtacgactccacgagatcgtatccggtggtgacggtgaggatgatccgctgttcggtggtgccttcaccgaggaagagcccgaggatgtattcgacgaggtattcgatgacgaagacgctcctatctaagggcttggaggatcacgaggcgggggtatgcccattgggctgcccctactgcttaattgaattcgagagagtgtggggtgtaagggtggtcagttctacagctgcatctaataataaagtagaggtcgatcctaatggaatcaagccgggtgagccgggcgctaaacttgatagcggcaaggtggatgttggaatcatcttcgaagcgttcccgagggctctatatgcagtggcacaagttgctaacttcggagccagcaagtatagtcgcgggggttggaggtctgtcgagaacggagtccagagatatgacgctgccttcgggagacacctccttgagcgacacaagggtgaggctttggacccccaaagtaagctaccccaccgataccacgaagtgtggaacgccctagcgtccctggaactcgtcattcagcaagaggaggactccaatggaacttctgttggacccaagggctaagactgttcctagcaactactctgtaatgggcattgatgtagacctggggcttcccccaggctacagcctaacggaggaagctatggacaaggccaagcgtcaagagagtgagtattacgactggaagggctacgaggcactggttaacccggtggtagagcacccagagtaccgagccaagggtgaagcctttgccctccgtgtcttctgggaagagaagctcaaagaatcccaggtcgtagaagaggtagcgtgatgatagctggtatcgatggtgacgttcttaggtatgagctaggccacgtggctatgtcgaaggaacacatcttcgatatccaggtggagaagccctggcctgaagaggaagtccacaagctcgtcgatgataaagtcgaacaaattatcaaaagggtgaatgcagatgagtgtgaaatctaccttactggccaaggaaattttaggctggagcttgcgaaaatcaagcaatataagggtactcgaatcggtcttgaaaagcctcatcactgggaaaccgtgtcagccagacttaaggacaagtggggagcaatcactttccacggtatcgaggctgatgactggctcggaattcgagggactgaagagggagataactttacagcgtgttctagagacaaggatatccgccaagtcccaggatgctaccattacagttggccctgtggagattcccagccggagttgggaccatttcaagtcgatggccttggaacagtctccgcttcttggcgaatgtatggtgttaagaaaccgcagaagtcatggaaacttgagggcaacggtacggcattcctctacgggcaactccttgttggtgactccgtggataacataccaggcctcccagggacgggaccaaagacagcggcagatttgcttggggggctttctactgagagggatctcttcgcagcttgcgcttacgcctaccaacagaagtacggagataattggaaggagtaccttgtggaaaactttcgtctcctctacctcattcgggaccgctcttggcttgatattcagcagtccggtaacgagtatcactgctcactgaagaaacattgggagattccctatgacgatgaagaaatattctattgaggaagcacagaaaatctgtgaaggcctctttgagatccttgagggtcttaactttactgactacaaggtcgctgggggttttctcagggatgcagacaacggggttgcacccaaggatatcgacctctatgtccgtaggccctatgtggaggaccccactgatactcggcgtagtcgctttggcccacggttgatcccctgtgatgacgataccctagaggtagaggtcactcgattctacaacaagctgggccacaagaaggtccggtgtaggactggggataagcctgatgggtatcctgcggggtttgatgtgtgggaatccattggtgttgacctacccgtcaaccttgtcgtgactacccattcccatccagcagagttcgatgtaggcctatgtgagatcgcatgctggcctgtaaatcggttgggtttgaagtctcaaatctaccgcgcaaaggcttatgagtttgataaggaagagaagtgcattaccctgaaccgtcttctggaccctctcctggatcattctcaacccctaactgacaatcaagttgaaaaggttgtctctcatatccaacgtatcaaactgaagtatccggagttccgggtgtgcctgggggattgggtttggctgctgatccggtctaactctgtcctcactgaggggacgctatcggttgtccgtaagcttcaagaaggagggctcattggcaaagcaggggagattcttcagacccaaactgaagtcattgattgggacgaagtacgacagcgaaaccgagaagatcgtccacgagacgatgccttggatgcagttcaagccggagtcggtaccatacgtcatcgaacacaagtacaagccggatttcaaggtatcgaccttacaaccctgtggatcgacgaagcatctgctggtagaggttaaggggtacttccaggaagcctcggaggcatctaagtacatctgggtgagggaggctctccccccagatactgaacttgtgtttatcttcgagcgtcctaacacagcttgccattggcttagtaagcgtaaagatggcacaaagcaatccatggcggaatgggccgaacgtaacggattccgctggtttactctagagactttcaaggagtccttccctaatgagtaaaaagtataatgaagacactctcgtcattgcggacacccaagttcgatccgaggtcaacatcgatcacctcgggaaccttggggagtggatcgcacgtaaccgccccaagcgaattgttcatattggggaccattgggacatgcccagtctgtcaagctacgaccgtggtaccgctaagatcgaaggccgtcgagtcctcgctgacatacaagctggtaatgatgcgatgcgagttctgctcgatcctcttcgtcgcctacagcaacaccaagcgggttgtaagaagcgtatctaccgaccggaaatgcacttcttcatcggaaaccacgaggagcgtatcaagcggtatgaaaactctaaccctgctctccaaggttttattgggtacgatcattttgatctgtccgattggattgtccatgatttcctcgacgtgggtgttatcgaaggtgtcgccttcgcccactacttctacaatcccaacagtggtcggccatacggcgggagtgccgagcatcgcctcaataagatcaagcgcagcttcgtccaaggacatgagcaggggttcaagtaccacatcgaggcagtaggtaagaagcgaatccacggattggtagtcggtagcttctatacccacgatgaatcctacaagggtcctcagggtaacgaccattggcgaggcgtagccctcctccggaaccacaaggatggagagtatgacctcaagctgatgagcgtggaggagttcctgtgagtaagttcttgccagacctgtactatattaagtctgagcatgacttcggtcaacgggggttggcgtttaagacgccgatctccgcagaactctggctggatatgaagtttgggaaagggggtgctgaggaggggcttaggcgagggatgtattccatcgaagtcctggagatcctctacatccccagcgttcaccttccagatatcttggggtaatctatgaaagaccgagtgggacgtaagctagaggtaggggacagtgtagttttcctggtccacaggaacacctcctcccatctagctattggtacagttgatggttttactccgaagatgattcggatcaaatgtcctaccatgagttggactattgattctgagtatgttctcaggggcagtgacaaggtggtgtactatgacaaaggctgaactggagaaagcacttgaagaggcgcaaagcgctcttgcgaaggctgaggcgaaggccttttcctttgaagaactggctgaagaagctaaaagacagattgaattcctagaagggatgctagacctagtagacctcagggcttctgtattctacggagattggaggggttatgcagaaagatcaaaagggtaagggtggattcccttggacctacattgcggtagcagccttgtttgccctgctggtatatgtaggatacagctgactgatgttactcctgaccctgggagaaatatctaggttactcatcgatgtattatcttgggtaggttctctatgaagtatcgagttaagcaagtggggaaattcttctttcctcagtataagcaatggtttcgttggaggaacttcgaacagagcaagcaggggatgggtgtccaatacatcggactgatagaatcccttcccgtggtcttcgagaacctacaggatagctgttgcttcatccgggatcacatggatagggtgtcagaggatactccgatctaccaccccgtcgagtaaccaaaaaaaaggccccaagggtatcatcccaaggggccttatctttagctccggagagcgttcagtagtgtattgaacttatccacgagtgcctcgtgagtatccgtataggaagccacggggatctcagcgaccttacccttgacgtaagctgcaatggctgcatcaaggccactcacttcactagccttaggcttccagttacctggcttagcctcgctagccttagcacccacctccagaagctccggcttcccctcaatatcctcccacttcacaggctcaaagtctttctggccaatgacttgtcggagggtcccatcttcattacgtacagcaatagccttcgattgaataacgaatacactgttgccgtcgttgtcagcgatataacctgccataatctaactcctaattaaactgccgatttgaaggtacccacggtaccaccgaaaggatacactcggacagtgcattccccaaattgaccatcagtctccgtctgattacccttagcataccaagctttgtccggagatacagcgaacttgatcttagctgccgatccctggataaagtggaagtgacaacctggggttacatccgggccaagagtcacggtaatatccgtagtccccagagacatgaagaaccatccagattgctgcttagtcagggtaatattctgagtaagctgctgggtattgacgacgttaccacccaggtgagtagtcacaaggcgggggtcaaggtagttctgttggagagaaccaatgttcttcacaggaccacgcatgtcgtcaaactgctcgataatgtagtcaccgatggtaccaccgttttggtcatctggaccaatcacgtgcttgatagccacgtaaacacccaggtgttcccgacgggggtctactcggaattcactaccgaaggcagtaccgcaaggggcctcgatcatggtctcggagaagagtccaatgacgtgacctgggtctcggttaccaccagaggtctcccctggggcacccacgagggtgttaaccaggacagaggggataacagcctcggatggattatccgggaaagaagccgttacgttctctacaaccagggctgcgttctctttaactgcgtaatagtccgggaggaactcagtagcagttacgatgttagtattcactcgacccgcatccgaggtaatctcaatgagatcaccatcggcattacggcggaagacctttggcacatcaaccacgtaggcacggccaccaggaccagcggcttcagtttctacataagttgccatattacttctccttaaagatccagggcatcttccattgcttccataccggcaacgaaaggacgtgctggagtttgcttatacaagaacttccaaatctcacctgcggaagggtcatccccgaacgaggcaatagttttaccaacagccatagcaccctctgttgcagcaccagctactggccccaagagtacctctgcgggagtagttccccgacggtaacccgttagcatgtcgtagatcatagaagcctggagtggcatctgttgcatcactacgtccatcatccgttgctctggactacgggtatcctctcggctagatccaccgaacttagccagctgacgaagctcatcctggagataccccagactcatcatcagaccaagagtgaaggctacacctgcggcacccataccagcgttggtccaagaaccagcgaagtgtgggctcagtcgtctacggaacatcggtaggatgatgttaccataggctgctgggtaacccttcaagagggagaacatctggacgtttccgttgctcatccacataggcttatcagcgaaggtggggtcgaggactacctggtccacaaaccgacgcatagccaaagtcttgacgttgttagccatcaggacttcagacggagtagctggggataccagcttaagggcatcctgctgactaccgatgttaactcccatttcccgaagctgagcaaccttcagagcaccattggcagaactaaaggggagccctgcggctagatccatcaggttattctgatagaccctcttggcagtctctgttgcaaacactcggttaacatgggttaggatggacaagccgttgatgaggaactgaccacggactgccttttggatagtcgtgttaaatacctcagcaccaacccgatctgccattagagaggtagcagaggccagggtgtggttcatatcactcataaaccgaccggtctcagactttggaatcccactgtagatcctacgggctgcctgtcttactacctcccccatggttggcaatacagccccaagggttggcatcacaccagccttagcgaagggcagactgaactccgtaagggtagagaaaccagcaagtggcagtcgggagaggacaagggcaccagaggtaacagccgccagcttcttgatattaggatctttgatacgaccgtgcataccattgtaggcatccactaggtcatacatccgatccacctcttccttagtaacccgcttaccagcccgttgagcctcagctacagcagatgcaatcttagcgttagccttctccccgttgataccaaaccgttcggtaaaggcaatccggtgggaagccccttcgaagtagtcccggatttcctggagacgcttcttaggagtatcgttcagggagtatttattcaggatctcctgaggtacagaaccaaaggcccggctctcttccagttgaccatacttaggaactgcatcgctttgggcaaaccgtccacgtagagtatctggatcaccttggatacgataacgagggtctacttcccaagccccggtctgctggttctgagtaaccagtcggttaacctcaggggcagtgttaccacgagtatcatccgagacttctaccaaccagttggctacagcatcttcagcagcttgacggttctggaagtacggagtaatatcattcaggaactcgggggtctgaaccttctctggggatagaccgaatggcatataatttgggatagtaccaacggacatcccaccacggttaacagcctcattccttacgtcatccatcaaagcacggagacgggtagcttctggggtattgacacctgcggatgtatcagcgataatcctatcgatctctttggaagacttaccctcaaagatgttatctagttcagagttccacttacctgcctgtagttcctggtcctcaaagatagtcttaccagaggcccgcttaccactcatatcagccctgaaggtctcagagaactcacgggcgataggagaggccttagcaagtggctctagaagggacgtagcttcgtttccaagggcatcccaggccttcttgaccgtacccctaggctctagctcagacgccttaggaggggccgcaggagcattaggatcaacaatggcagagccagctgaatcctgatgacgacccagggtgtccaaaccagaggatacagcaccaccagcagtacccatagctgtaccagtaaaggcagccgtcaggaggttatccatgaactgctctggggtttgtacctgccctactgcatcataggcgatggtatcctggagcgcctgttgagcaccagaggttacaccctcggctacaccagagactgctgcatgcttaccagcctgggtaacagcctcgatagcggtttgcttggggagcccagactgaaccagcatctggtatgccccgtccttaccgatgtgcttcaagagagggccagcgatgaccccagcaccagcggtatccagggcagacaacccagcaccaccaatgactgcggtccaggggttgctttggtctgggtctagctccttcatctggttgctcagggcacctacgttgatacccatggaactcaggaaggaaccaatgagcgctccacccatacgaccaggggccccaaagacagagccagccttagcacctgcggcaccaccagcaagtacaggggccatcgaagggagagcctctacgatattattcttaaggaacgacccgatggatgggatatcttggatatcagcgaaagaccgaacatcaggggttccgtactgtgacgcttcctgagcattctcctcggccatctgtgtgccgtagtctttcaggtagtcactgccagtcagttcaccaagggtagcaatagtaccaccgatgttagactgcatggtatcaaccccacgaccaatcgcagagctgatagaattagggtcagccggagttaccaaggcactcaggtctggggcaggctcaggggtagctggggatacttcctggggtgcctcttcgataacctctggctcattcaaggaagccaattcagcggctacgtcgaggcccttgacctcagccagttccgcatcaatagcggccttcagttctggagaaagagccataagtcaccttctagttgctggaaagagaataggctcttaagatgtatcctaggatactaaccttcttagtaagtaagtcaaaaggaagaaggaatcttaagagcctataggtctattatactacattttggatactttgtcaagtaccttttatcgggttggggcaggatagtccagatcagcaccaaaccagttacccgtaggttgaagcttagcagcctcccgctggataatacccactgggttagcccccggattagcccgaagttcatttcggacagtctgggcaatagcctgttgggcagtcttactcagcttcttaccacccagagcctgagaaccattgacttcactcaggataccaagggcgtccttagtagtaacagcttcacctcgggctgccttagctgccgcttgacgtgcctgagcgctgatcttagcagtcttcagacgtacagcagaactaagctgggcattctcttgagacatatcctggccacgacgggttgtttcagcctgtagctgagcccgttgattagccagatcctgtccacgctgggttagggcaaggttggctcgaccccgagcagcctcttcagtccaccgagccagaagaccagtgttcttacgagaggtttcctcaagagtgcctttcttgacctccaggtttccttccccgagacgtacatcagcagcatccttagccaccttacgttccagatccttttccttgatctgacgatcagcagctgcggcagccatcttctgttggttgatcccagcctgtaggttacgatccagctgacgctcataggaagcagcgaacatatccccagctttaccagtcttgtctagggccgaagccagaagaccagtaccaatgagagcgtaagatacataacgagacaggtcatcattgtccatagtcctcatctgggtcaactcttcgttcacccggttcttaagctcttggggtttaagctctacaccctctctctgggcatcagcttcaactacagcctgggccatttcaggacgacttacagcaccagtacgaagaccctcggctgcaccctgttggatgacctggcgattagcctcctcctcatctgctacagcagcaccagcctcggaagccacctctggggtgatctcaggctcgatagagggttggttaggggttaccccataggacaggagttcagcccccgtagggcctcctgtggcgttctgggctgcacgttggcctacaccctgggcccattggtttgcctcttgagcaacctcgggacccatgttctctacagcctgactagcctgagccatttcttcagcacgagtccgttctgcatccccgagttctcctggggttacagcggcttgtacacctacagatacaggaccaccgaggatacctgcgatacgacccaaggcaccacgaccagtagcttcagccgcaggtgcaacctcttgggctgcacgggaccaacgctctgggttctcaagggctgcctgagcagcacgacggacacgatcaggaatacctgagccctctacagccagcggcagtttgttccttgcgattcgcgccatatccagttcattctgagcagcccgaaggatgctagggcgaattggggacccttcataagccatgctggccataggattaacctccaaagagtttacttaggattccagacttgggttgctgtccgaagccgagttcttctgcgctaggaagaatgcccactcccgctcccatacctgctgcaacttccgctgcgcctcgctcgcttgctccccgagccccttcgacagaaaagcttggtactgcttctgaagaagactcacttccttgcccgaggagagccgcgagtgctgctccgcccattgcgccaaaagggtttgattgtccactagactctcccgattgcattgtcccaaggtgggtggggcggtaggaaccttgacggctcaactgtacccgctcctgcccaccacctatattctgtcctatagcgaacagcttctgaggaagggaggccattagaacagaaggcccccgaccctaccaccagcattcataccaacagaagcgcccgctggaccaccgaagagagcacccaaggaagcaccaccgagagcacccagggcagacccgaggccaccaccaccgccaccacccgaagaagtagtgacattggttccccccatatcgccggagataagctccttataggcgaggaggtcgttgaggctgacgttattctcataggcccacttctgtagagccccgttgatctcctgctgctcctgattctgaagcatactaccagcatcaacctgcatggcattaccagagcctaggcccttagcaatagccgagaggttgcccagggtattcaaccggttctggttgtaagcctgctggtcttggaaagccaactgggaagcgttattctgttgattctggagcaatctagcggtagcaataccttctgctacacccgctcgggaactcccatactgaccagcattagtggcccctgctcgcaggtctggacgtaccgtagtgtcgaagtcccattgcatctgctcgttggctgcaccaatggcgttcgccaagccagttttgttgggatcgtaaggaccaaggtaatcagccagagagctaacacctgagctacccaggagagactgaagggcacccccgagaccacccagcccttcgatgccaccaagctggagagcattttggtcagccaccgggtcaaagttcggatcgcccccgtaattggggtcaaagcccccgttatgtagccaatcactggcacccgagagtagttcattataattaccttgctgatagggtgtagagacagaggtggtcttttgcttcttgctaccacccttgtaagcccgagagtctagggcatcctctacatcgaaccccatcagacgctttacattaaattggaggaagttcatctggagttacctcacgatagaaggatacggagtcttcggtgtacccgagtttctctagggtaggcttccagccccgacgaccttcgcattggataaaccgacagttaactcgttgggcgaactgtccgaggaagtcgtctacctccgagtaatctaccggggtttcattcccaggcatcttaccactccagaagaagtgaaggatgttacccaggggtgcttgggacacttgaattacaccagcgtagccgctctcttcctggtagaagacataggcctcataattaaccaaggagtgaaccaagtgttcgaagtcccaaaacttaccgaggtccgtcctgttgaaggctcgggccagagcagggactacggtaggaagcagatcaatattctcacgagtaatcaaatgaatcatggagtcaccaccagggggaatgtgaatgtacccccgaagactgctccttggggaattccttggataagaacacggccattggctgtaatcttaaacatagcttggttaaccaccccggtctgaatagttgccctgttgagtacgtcaaagacttgatccaacggaggtgcgttagggtcagacggaggtggataagtaatagtgctctgcgctgggatgatgctggaataggccgggataaacaactcagcaggaggccaatacgcctggggaagatccaggacagtagccccattagtgtagttaccaccagacatgagcatggttatccatacttcatccttagcagtgttcatcctataggcacaggtacccatcggctgatggttgttctgtggggtaaataggataaaatcccccggcaggtccttgggtttagtacctgcgagtctccattggttatccaagtcgtaatgatagatgccggatactggacctaccactccgggggcaaaatactttacagtccctggcttgagcttcttagggggctccatagagaccccccagtagccgtcagctaggtcattaagagtctgtccaaccctaacgaattcttcattaaggaagggcagcagttcctcctcttcctgtggtggaatcgaagggctgtacttttgactcatcgcatacctgccttcggggccatttcaatagtgtatccgttgaagtaccaatccccctccgaagagaagtcgaacttcaaggctatataccggcccacatgtttagtgtcaatcttatagtcctgaccaatccggtatgggtaagggcctttccatcgaataccagaaccttgtacctgagcgttacccacccagatgttacaagtaccgttaccagtaatgtgtggaatgatggcactcactgtcttcatcattcgatcatccccgagatagatatcggatctctcaagggtactgacgaagctctgtccagagaatgtagagttattaccgaagaggaacaacttcttatcctggaaagacgagaagatcatactggactttgctgggttataagagccttcaccccagaccgaagtatcggtatcccaggggttggggtcgtcatcccagaggttagacaccttaggatcgatgatcccgtaggctccactgagaacgttgggaaggtctcggatactccaagtgttttccttccagttccagatgatagccctgtcgcagtgcttacctggctcagacctagtggaagagtagcatacccacatttcagtattcacgtggtctgcaagtacgaatgtccgttgatagttgtcagggttaatatccgagaagaagaacttacggacctgggcatcaataacagactgcttctgcacaccgttgtggacatatacatcaccgtgacctactacaaagtggttaccatcgaactctactgcacagttgggtccgaggatacctacgtcgttaaacagctgctggaattggaagatgaacaatccaccgatataccgcatggagtatacagagtcttccttgtagatgatgaaggagtcacgaagcttcacaccatccacgatagcaccattggtatcagccaaggtgttctgaccagcatccttagtagggtccgttgggtcccaagaagcgggtacaccaccagcatcagccgaggtactccaccagaccatctgtggcatttctacagagttacttgtagcgtttaagccaaccaggaagttcttaaaagacttaagcctcttaaaagtagtattcgctgggaagttagggagtaccctaaaggttgattctgacggtggaagatgatgaggagggttaaccccatcgttagcaaagattaccccgttgaacgatcctacagaccacctgttagttatactagcagagtaaggtcctggggatacatcgatgattgtagtcccgtcggctagatacaacctttgttcagaacacaggagccaataggggatgttattccggatgaaagggaacatatccaagattggggcctgggctgtatcaaagataggcgtatggcccagagccttctgagccttgccgttcttaaaccggacgttgttcccgaaggaccatttctccagtggcaggtcagcgggggcgatatcggtcacaatccccgtagggttcttgacctcttgtctctctagggccattgtatacctcagttcttaatgatgaagaacacagaacagaacggtgggatattacccaacggcatgttgatctttactgcatggttgtgagtctgaccttgaccagcagggccagtctcaaggttggtattggctgcgttaccagagcctcccgtcagagcacccgagtcacccgcagaaccggtgagggtagtagcacccctagttctccaagtgtgggtgtgtgatgggatttgggctagggtaagggcagtcccttcagtgaacccatcccatacaatgttagcgctaccgcctctagtacctacagcctgggaagatccgtcgataccccaggggaatgcaccaatgaggttggggacggggataccattagaggtagtccctacaccattacaaagcttccaacctgctgggatctgagccagtgacccagcccacatgataaccatcccaggtttaacatactgggttgtatcagcgactgcgtttagctgggctgccgttacagtgacagcctgagaaatattggggaaggtattcttaatagcactcttaatgagtcgcaggtggtcatccccaaaggacttcagatcagagccggtagggttcgtaggcaccaactggttaatataagttgcgacctcaagacccattcttggcctcctttatctcttctttcatttcttttcgggtgacataccgctccccaaagattgccatagaaatctggagatcgctcaccgcttgggtgagcttctccgtggcctggatgtttctttcaagcagagcctgatgaacattctgaccgacaaccgaggaacctaccgtcactaccgaggatacgaccagggcactgacgatgctgcccaggttatcagttagaagttgcatcctccgtcttctccttaaggttgtcttccaggacttttacgaactcgtcgtcaaccttggagttggtcttctctgccagggccttagcaccagtcacaatggacttagcgattaccttggttgggaaaagggtagccagaaggttgattgcgagggtttttagaaagataggcatctgaagctccttaacgttcaatgtctttgatcgccagtcgagtgctagcgaagtcagcggcattctcctcgttctggagttccataacagcccgttcgagtttctgaccccagaactgggaccgagcttcatccatggtgtacagataaatctgctcaaggacaccatagagataaatctgcggatacttcgtcagagcccaagtcgttgggttagcgaggcttagctctgggagtacagtccagtagttcacaatgaacggggcaccgtcaggaacaacggggaatactcgccagaagttacccaaccgagtgtagtaggttacaccctgaggttggtaattgtagttaacatagtgggtgaagatatcttgggtgatgtactggagagtacgcccaccgataagagagtcacccgtgatagaccttagagcaacaaagtgctcagggatctcaatgccaccaccgaaggccatgagagtttcgaagtgttcgttctccctcactcgtagcaatcggttaagacggtcagtagtgttcccaatgaacaacatcagaagttcttgggtaagatcctgacggtcagaccactggatagcagcaatagcgagatcagttacgttattgatcgtagccattcattacacccgtgcctcagaggtccgcatccgatagttatctcggtcattaagccaacgggtaaatcttgcggcatgatctgggtcacaaccaatcaggttaagatcgatgggaccaccttcagccatgggacgattccgtagtgcctctactacaaccagggggatacttgctaccttgcgcatattatccttgcggttgctattgacacccgagtggcgctcttcggcgttagcggacaggattgactcaacatcttgagtatcctttcggataaagagcccaaggtcttcgtcaattgcataagtcgattggatactcatgatgtacctcctaaggggaaacaaagggccccgaagggccccgttgggttagacctgggctacgacgtcacggatcagagcaccggacttctcgttgtttacacgcagggtgtattcaaccagcagttggcgcttctcgctgtcaccggtcttagccagttcgtgctggaagaacggacgcaggtagcagagggcgtgcatcttcggatcaaagatgaacatggtgttttcgtggaaccagcggttggcacgaatggtgtacttaccgaagtcactctcgtagacgtccacggtctgcgcaatgcggttgtccgaggcatccagggtgatctcagttgcacgacccttcatgttcttgctgatggccttcttgatcgagctcgaagtctggatcgagttagcctgaccaccgttgcgccagatagcctcagaggcattcaggagcatgtcttcggtcagaagacggaggtcaccagcggtaccagtgtcggaaccatcaccagttggcagggtaccgttagcacctaccgaaccgttggtcttgtagtaggcaaagatgtttgccatctgacccggagtagtggtgttacgctggatcttagcctgaggggcaccgaccatggcgtattccatgtccagcttcagttccttcgacttcttagccagctgatacgccagttcgttcttacgaccagccttcttgaccttatctgcggtaccggtgacttgcagggtctcgtccgagatttggcagtagttgttcaacatggtggtgaagctaccagccttgatggttgcatcctcaccttccactcgggtgttcttacccggctggcggagttcatcagtctgccactcgtgggtgatagcggtagctacgcccttgccgatagcagtcatgaacggggtgtcatagggtgcgatgttgtagatgatatcgataaggtcttcgcgcttaccgttgatctctacagtcgagacggcattagttggagttgccataagttacgtttccttctattagaaaatatcgagagaggagaagagagcagcagcggcttcaaccgactggtctttcctcagattagcgcgggcagctttaacccgcttagaaccctctgaggcttccgccctacgagcagcaggtttaactgcggcaggtagttcagtctcctccttcttctctagggcagccttgcgacggacctgagattcagcccacttacgtgctgcatcgagtacagccagttggcgggcatcagatatccctcggatctcatcctcggagtatccaatcgatttgccgtaggacacaatcttgtcaccccaagactcatccgtagtcatttccgggataagcttcttggctagctctgtctgacgcttaacgtaggcagagtggacaatctcggctcgcttctcttgcatagccttaatgtcgttacggcgtttgataagagcctgggctcgatctcgggcttccagggcttccagtcgaagggtttgatacttctctgggtcctgggccttaagctgctcccagtttacattgtcatactgattagcaccagcaatagcggtaacagcgtactgctcaagctcggccagtagattagagcgttcagcatcaagctcttcgaatttagccgcatactgatcctctagttcagcctgtcgagttacaaactcttcattgcgaaggtagccactcttaagctcttcgaagttaacctcgtagacttcatccccaatcgggatctcgaagagtttatcctctggatcttcctcgggggtatcaccctcggactctccttcagactcttcttcctcctcggactcaacctcttcggtgtcctctggagtaccctcgtctactacctcttcctcttcttcctctccaacgaccttaccatctacggtttcatcaccgggggccaggaggtcatcaccgagcaaatctccgaaggcttccgctgcctcgaattcatccatgccttgattctcaaggtccattacttatactcctttagagtgatcgaatccaggatagcctgaatacgaagttgtacgcggttgagggcgtggagttcatggtagatggcctccctggattctgaatccttaggtgccgtagacttccactctccctcaatctcttcttggacaatacggaaaagctcaggaagaacgttctcacgtaccatctgttgtgccgcatcagtcagcactagactatagccaaaacgttctcccaagattatttcctcactgccttagatggcttcttagtctcaggtaccttaccgtctccgatataagcagcccgagcctgagttgcctcaagatgatactccgcttcgttacgagcccgttcccaagtgaaacgatcacgctcaagttgtagttccgcttccttaagggccatttctctctgctgaaggacagcctcttgcttcttcagttcgatctcagccagtcggatctgagcctccacctgcttcatctgggcctccgcttgcttagccatagcgtccgattgggcacgttgggcatcagcttgggctttgatatcttcaggcttaggttgtgcttccttctgctctctgatggccttagcccgttgagcttcaggagaatccgggttagtccagaagcgatcagggtctttgtacccagcgttctctgtgacttccttaaggatattgtaaaggttctgctcagagacaaggaccccaagaccaccaccccctactacagcctgggccatttcccagatacgcataaggtggagcatctgctggtctttgttcatgttgccgataccaacggtaaccgtcaggtcggatctctctcgccagttggcagggttaatagcaacccacttgcctcgtagctggaagacctcttcctgattctggtacttgatggcatggtcatgcagaagttggaacaaacgcttaacaccagtctctgcaaacatccgggcaatcaggtcaatctgttgctcagcagcagtcatcaactggttaacactcatagccgcttggttagagtgtagggtgttttggtctaggcctcgggtacggtcagtgataccagtccgcttacccctatccgcctctagcctatctagcataccgtagacttccccagacagctgaggggtctccagaggcatgatagagttcatggccttaacccgaacgatacccgctgcctcgttggtcagcaagtcttcgaggttaacctggccatccaggactacagagcgcccttggttggtccggtagatgttgtccatgatgttgcgcatgagcaccgaacggatctcttgaatgtctcggatcttatcgtagacactcatcccgtggaacttatgggcaattcgataggcattcaggtcagcgaagggacggcaatcccaaggctcgttgctgatgatgtagtcgcccacgtacaggatacggcgcaactcagagataccatccccatctacgtccagaagggtgtagcactcggaggcccatacctcacggttggcttcagcatcatccccagagttatactggagttggccagtcatatcgaagttatcacgtaccaacctttctggctgactatcagagaattcatactcatcgtatggaagctcatctagtacatcctcgggaacacccaagagccgcaggtcacttacggtatacttctcacggtgacagaggaagcgtgcatcatcgatacaggtagccaaccgatcaaccaggaagttctcaggcttgatacaggtgactttaatctctcgcttcttcttgtccttgcgaattttaatactgtaggttccatcctcgtccacactctgtgctagaatctcagtgtctggatcagccaggatatccgctaccatttcctcagagagaccagagaatcgttcgaaggtaggattcaggacctcttctacatagacctttacaacaccggtcttcatcatcagagtgtcttggaaccagtcgaacattaccttgaacccctcgttcttacgcatgaagaggtagttcacatactcagtctcttgctctgcctgttcaacatcttcggcagtctgaggttcatacttaactacttgaccgcctgacgtgaataccttcataagagaaggcataatccagtctacagtctcttgaacgtccctagatacaatcgcggacttcccagggcgctcgttaccgaagggctctccgaagtaatacttcagggcctcagagcgctgcttggaaagttccgaagagttgaaatcaagggcgtcgttaacaagttggtctagatgacgaagtacctgttcatcatccataggcttaatcttgcgacgacgcttagccattagacaatactcccaaaccaatcaggggtcaactttgcagtatcactcctgtagtatccactgtttcgtacagcaccaggacgggcatgccgggaagccatcaacagggcataccgggtagcggagatcatatcgtcgtttcggtcgataatctttccgtcctttcggtggtacattttcatttcttttaggaagttcgtacacgtattaaacaccttcagatcaccattctccatacgggtcaacatccagttaacgccgaattctacagagttacctccgtgtttaccatcaggacccggtgggttgctgaacggttcatacactacattgaggttgtggtcatctttaagaaggtctacgaatctacgaccagaggttgctccatcgtgcttaaaggcatcgtggggaacaactaccgggatctggtgaccacccttcaggtagatagcatcagcgtgcatccccaaggtctcaccactctcacttctctcatcatagaggtagtatttgtctttctcaggatcccaagcaacacaggcgatagcgttagggtggtcaaacccaaggtcgataccgatgatcctgtggaagtggtcagggatctggaaaggctcacatacaaacttctcttccagaatggggaagactacaccagatccgagcataggaacaccctcggccctcatcctgcgttctgctggagagtataccgagagtagctgctctttaacttctggactgaggtgtggggcgtcttcccagcttgcatggattaggaactgtccaggtttaagatcctggaggaagtccttgacgatctccgtcaggccatgctctggggtaaacgtcagatatacaataccaccagtagtagccgttcgggttacacactgggtataaatatccttggggcattcctcatcgagccagatgacgtcgatggcagtacccatgaatttgtcctgggacatttcgtaggacttgaagataagggacgagaggcccccggaggcatgcttaacaactactgcttgcacacatccgggtttaccttccctacgaatcgtctctacgatatcttccttggggatcatccccgttccaaaagcctcagggttcttccagtcacctagtagttcggactgaagaatatcccgagtggtatccgtggagatccccgccgcccagcagttcactggacgatcatactttctaccagtccaccactcagggtagcgaccggtgaggtggcaggccatgataaaggccccggtgtaggttttaccacagcggttaccagtcatagccagcaactgggcgcagttcgaggaagctgcgataaacttctcttgccacccataaggagtgtactggttcatgcggaaatacttctgccgctccgccaactccctgactagattccgtagccgctcttgggtatccattagaccaccttgtcacctactgttgatgcacgccacagggcccgttggaggtctcttacgcgcactggagtttgtttagcccagaggctatcctctgcctcccatgcagcttcatcaaaccttccggatttcagaagattccacgtcttggggaacttcttcgtccacgctgtacccagctggaagttgacgctaactagggcatcgaatagctctggagtgcaaaaaggcagctgagatacttgcccttgggctgcatcataggctgccttactatcgttctctagccaagtctctgctcgggctagggtaatcggtccgtcttccccagggagttgcaagtgaccataacctccggtcattttcccaagggagtctttgtaccactttagaaccaacccctctcttcgcttgattaggtcaaggtacttaagaggttgggaaagaaatgactttagccaactctggctcttcgtcgagaattcgtcgaacttcactgattagatcctctgcggacatatcttccacattcttagtagtaagctccagtttctgcttagctccgaagcctccacggtccaggatatcctgggctgccttgaggcgaatcccacctttctcttctgggttgctagcaatctctacaaccacacgaagcgccatggggacatgactcccgatgcgctcagagataaaggcgttgatgtattcggcatgctttcgatggtatgcagcaacgttgcgttgagcgtgattaggagagaacccagcggctatatacgcttgggttttattcataccatctgccagagcctcacaatagaggtctagcttttctttagcagaaagaggagcagccccaatcgagacaaccttttcgtctgacatacactgctccgatctctctaaatggtcaccccggtaggactcgaacctacgacctcctgtgtccaagacaggcactctaaccaactgagctacgaggagttaatggtggtcgaaggaaggaattgaacctctagccaatggcgtccgggttacagccggatggtagtagccatctacctctacaacgacctctgttggctgggacggcagggctcgaacctgcgacctgagagttaacagctccctgctctaccaactgagctacatcccaatgaaatcttaaggtaatttctcaaccttataatactattatatcacactttttctattttgtcaagtcttttttcttctttttttttattttagtcgcaaggcccggttttgttagggtttttgctggaatgggaaaggggctcttaagactatcttaagataaccttaaggtaactaaccttcttagtaagtaagtcaaaaggaagaaggaatcttaagagcctataggtctattatactacattttcgataccttgtcaagtactttttgatatttctttgataatcacatgatttacccgacgaacggtatgatagggttctatagatataccctaagactacccttcgtaggttgctggtaaggggtaagtggcatagggttcccttgatcaaggttctataggtactccctgaggttgttccataggtatacccctagactacctctgtttgctatgtcctggcctattgcccctttatccagtaatataccaacaggtatcgggggttgcctttgatccagggcctataaccgggggtaccccaaaagtctattttatcctccggtgtatcttgggaatatccccccaggagtcccccagataaagtgggggtggcctatccccaggggtactagcccctagggcctccctaggataccataaggctagtccgggggtcaacccctagggataccgttcatcgggtggacccaagggtattcataagaaaaatcttagggtattcaggggggtggatcgggggggaat

SEQ ID NO: 13 - DNA, 44552 bp, Podoviridae Bruynoghevirus
  misc_feature (1)..(44552)
tcttctcgccgcccggcccggttttgtttgcgtttctgctggaatgggaaaggggttcttaagactatcctaagataaccttaaggtaactcaccctcttagtcagaaagtcaaaaggaagaaggaatcttaagagcctataggtctattatactacattttcgataccttgtcaagtactttttgatatttctttgataatcacatgatttacccgacgaacggtatgatagggttctatagatataccctaagactacccttcgtaggttgctggtaaggggtaagtggcatagggttcccttgatccaggttctataggtactccctgaggttgttccataggtatacccctagactacctctgttgtctatgtcctggcctattgcccctttatccagtaatataccaacaggtatcggggggtgcctttgatccagggcctataaccgggggataccccaaaagtctattttatcctccggtgtatctggggaatatccccccaggagtcccccagataaagtgggggtggcctatccccaggggtatagcccctagcccctccctaggataccatgagactaaccccaagatcaacccctagggataccgttcatcgggtggacccaagggtattcataagaaaaatcttagggtattcagtgggtggatcggggggaatatccattgataaccccttgatcccctattgactaatccgggggctctatgttagtcaaagactgttcatatccgggggtttgctgggggactactagcctacaggctgtataaaaaaccagtagacaaccccgtaaagaatatggcgtaatggcgccgcctttagggaaaccgataggcaacgggggaaaccccaggggcttgacaaaccccgcggaaccgggtctaatggcccccacgttctacctaggccaccatcccccttgccgcagtgctatccgggggctgccaactcaggaagagcgcccaagtcacccaagtgtaaggccggcaggcatcgggggttgacaaggggtaggggaagcggtatagttcgccccacgtcaacggcataacgtgcatgactccctagggattagcgtagccttgacaagcaagactgatggccgctcagcaaaagagcctatgccagagaactggacgaactaacccccgtcaaagggttgacaagccaagcccaaggctctaacatgggcacccatcaggtgacggccacctggggaaagtgtaccttcgacggtccttggactgaacaggggagaaacccgaaagctgagggaatagcgcatactccgattagagcgctggctttgatggtcgctgccttatgacccatccgactggttgcctgctccagcgtaaacaattagcagagtccatggtggaatcgtgatggacagtatgttgggttagtatcaatggcttagcgcagagggcgaagcttggtagatactggcgaaggtagggacgagtagacacgaagactcccaaggatagccagaggacagaccataacagcgatactaacgcggaaaggggccggctacgccaatgccaaggtttgccgactaacccctttatcgtatcgggatgcgtgtcccggctgatgattccaaaaggatgaaacgatgaacgctgctatcgataagaagctgcgccgcaaggctagtcgcaaggctcgtgcccaaggtctgaacattgggcaccttggcaaagctcagcagcgggcagaacagaagttcgggatcatttctaattgtaacaaaatcctggacagtaagtatgtttcacttcaggaaaaggctggagcacgcaagcgaaaggctctgatgaataccgattggcgtaatcgcgaggatactaagctgcgcaattggtacaagcctagcaagtgcaagaactcccccgtcacccacatcaaacccgaggtataagttatgagcgactacaagcgtatcaacggcatcatcaaaaccattgccaaccggggtgctgccctggacaagctggttcaaactaccggcctggacattctcaagcacatcgacgagcatggcgaggtgtccttggcctgcaagctgttcaacgcgatgccgcaaggctcccgccggctggccctggcacactggttcgtagacaacggcaagatcgcggccaataccgacaaggaaaaggccaaggaattcccgttcgtcttcgccaaggacaaggctactcgactggagcgtgcagccgagaaaccctggttcaagtacaagaaagagcgtgacgtggccgacgagttctccctcgacgcggccatcgccgccttcaaggccaaggtacagcgcgccatcgacaagggccagctccaggcagcggatgagcgtatcgctatcatccaacgactggaagtcaaggacgaagcgaaggcagcgtaacggcggatgcgcctggggtgtgtactatgacgcgccccaggtctatccctagagtgcatggtaggtccgtgcattgtagcgatagaccatcaggaggtttccgtgggttactgtatctttgggcaggtccataccatccaaggccaggattatgtttctggtttctgcgatgcaagggtaggtttcgacgctggtattgtgtaccgctggacattcaaggacggtaagtttgcttgtggtgtctacactctggacggcatccgtctgagcatctgcgggtggatcaaatgaagtcaccctacgaagcggcccatgaacgtgcccaaatgattaatcgtctcaagaaactcactaggatgatccgggtgcatcccgatccccggtggattgttgagcgccaggaactcataaggaaacttagcaaatgaccatcgctatcatcgtatccagcatcggcatcgcatacttcttcttccgtgactggaaggaagagatgggtatcaactgacccaactgatgaggccatggtgattcctggccgaaacccccaccgaacctatggttgcaggctggggcgtcttgggaaatcaacaaaggaaactatcccgtgaaacgcaacgactatcgtaaggtcagccgcaacatgcaagccatcgaggctatcgaccgcaagattgctaaggtaactcgtgagttgaccaactccagcggcaatcaccttggtaaaaccctggagttgaacaagctccgtgccaagcgggcatccttggttaagaacagggcgcggtaatggcatggaagtatattgcatgtgccgccatacgctcacgttccaatgggttgttgctggtagcgtgggtggttctcttcgtcctgtcctcgaccttggacagcaccccttttgcatcgtgaggtagttgaggtgaggaccactaaagaattcaactgctacatggcgatagccacgatgataacgctcgggtttatgacatggttagtttatagccttctcaggagctgatggcaatggatatcaaaatctggccccgcaacggcgtaaccctcaacaacctggtcaaatcccaaacattcctcatcggtggggatgtgtacatggtctgcgaactccgcagcattaagatgaagggcgaatccgacgaggttcccgttctcaatctcaagactggcaacgtcatctacatgcctccggtgagcctggtatacccagtaactgccgagctgaattgctacgaggtgtaacatgaaactccaatacaatatgctcaccagtaagatccgggttgcctcttgggatgatctggagtcgggtcgtctgtacatccgccaggacgaggacggggctgcaaacccgcgtgtctttatgtacatggaagttgcagatgaattcttcatcgtggatatcttcggtgggcccgtgggtgccgtatacttcagcggcgatgttgactgcgggttctaccccgtgaccatcaaggctgcgtccatcgaagtccatcggttcggccctccggcctagggtgtgtactatgacgcccgccctgtatctattcctctggttggaatccttggtcagcatccgcaggttccagcctaaccccaaggcgtaccctggttggtacgtgacccacatccgtgtatctatcttcggcaaacgtgtaggtatcgtctatgaaatccactgaaccacaagtctattggttggccagtcccgatggtgaattccacctgaaggtcatcaacttcggccagttcatcaccgaaaccctttacgaactcggcattccggtggaccacaaggttcatcgggtccactgaggtgacccatgacaaacactaccttcactgtagcagcgtcccgcccccggaacgaccttcacatcagtaagcgggcggatggggtttatgtgaaccctaaaaactctggcgatattgtcttcctcaaggaaggtaataaggttgtcgtcctcagccagagcgggttcagcatcctcgaagcccagaccatgcccaacatcggggagctctacccggctaaggaggtccatgtatccgccaaggtgtggggaccgtatgaagagtaaaccaatgatcggccaaatcatggcccaggagcggcgaatgaagcgtcgagtagagaaacgagggttcaacatgacccatcaggaagtcacccaggagccccgtggtgagcttggtttcaccttggctgccgtaggtatggagtcgagccgatcggcttacctgcgccacgccagggaggccatgatccaatctggtgagccttgccctcattgtatgccagtcttcggtcccaaagagggccgttgttgcaactgttcgagggactggtgatggatctcggcaacttttggtgcctattgggtgtccatcggtacaaaatacttgatggtggaccctacgagattcgccacaagggtcggttagtggaactctgccactattacgacctgaggtgcgatcgctgtggtgacgtacatcgtaaggtggtccgtagcaaatgagtatgtacctcctaataatcccagcgatcctggcctacatgtcggtagcccttttgatatccggggtttccgcactctttttatccgaccagaatggaatgatgggccagagagaccgggacattgcaatcgtgatgggtgccctgtggcctgcatcgcttccctggatgtgcttcatggctgttatctacaacccgctggttattctcatcggatcaaccaagcgactaatcaaaggagattactaatgcaacgcaaagacttcccctcctgctgcaccgccaagatttacattggcatgggcccctcgggtactgctgaccactacgcaggcattgcgtccaatgggttcagcccccgtggtttcgccaaggaattgatcggggtcatccgtcgagagtacaacgaaggtcatggcaccgccgtgttctccgtgaacaacgagcaggtggtagccgataccatcctccgccgcatgggcagccactacaacccctgggcctccagcgccaaccactcgacgaaggttcgggttcacgtcatcaacgtgcaagctgcggcggagatcctcatcaaccacggtgtcctcatccgccgactcggtggtttgcaggacttccccggtactgtcgagcactcggaatacctcgacaagctctgtaaaggtctgtaacatctaggccttgacattctgctgaaagtgtggtataataaccttaaggtgtccggggttgctttatatccctaggatacctaaggttctaaccttctaagtaacttagaggtcgctagtaatacccctagtattcctgtcctgggggtattgctggctaactcaaccaaggagaaaacaaatggcccgtatcaagtatgccttcggtatgaaacccaagaagggcgagggtaaagccctcaaggtaatgacctcttcctcctgcttcggtaccatggaaggtccggtaacctacggctataagctcgacggttggaccttcatctgctcccgccgaagcaagaggttcatcgatgtactcaacaagtgtacccaaggtgaactcaagaccatcaccatcggcggaaaggccttcaagatcccgaaggttcacttctggtcttacgaaagcaaggccaaggattcccccttcgagaagtattctaacgggacggaaatgatttcccccacccatcacggaaaggaaggtgtctgcggtatctacttcaaccccaaggtacacaccctggattcctggtaccccatcatgaagttcctcttcaagctggtatccagtggtctcgaccctcaaggtcgtgaagaaaagattcacatggagcttgctgagaagtatggcttctggaagtcttacctagcaatgtcctttcacgggctgatagccaatggctacaccgggtatcccctcaccaactacatgttcagtagtgattgggaggatatcaagaagggcgatatccatatccagtccgccgaagagtgcaaccgattcggccgttgggtggccaaccgtaatgccccaggtggacgtgagtgggtaaggtccaagccctacaagtcagaacacctggggattaagctgaacaaggtggaggtggtaactatttacccccagccaaccatcttcggcaagaaaaccccctacgacaccgtggatacagagttgggaggattcctccggcttactccttctgactgtgaaaaacacggggtggtactgctggggatcatgggtgaaattacctggtctctaggctcaagggatatccccctggccctcgaaggcttcatcgagaaaaacttctgacaaccaaggagaaatcaaatgggaatgtatgcagcccataatgtgtactataacgccgaagggtctgtggtacaccactactcggtcaagatgatggccgaacatacaaactgcttcgggtcctattgcgaccagacctccgccgttgggggcgaccggtgggttaccgggattggccacctgttggtgtctacccacgagaatacctctggtaaactggtggagttcctgaacagtgatctggtcaacaggattaccgacggtggtattctctcggcttccatcgactggcctactcgttggtgggattacactggtgatctcaagaatctcagtgatcccgaccacttctctcccccaggacgccggcaggcagtctatgtacgggtggacctcaggaagaacgcatcggccatcatttgtgccctccgaatgggcgatcgtctgtgggcaataggtgacgcattgcgtcgctatacccaggaaaaccgtgataaggtcctgggatgcaatgcagagatcctcaccctcgcggcttgtgcccaggtaggaagcactgctcactgcgacagctatcctgccatgttcccggtgactgccggtgaataccgggaaggatgcgaaagtcacggatgggaggtggacgacagctacataagcgaggtcatggatggtatcgtaggtgggtacaaggagatcacctacttcgatatcaagagcatccatggtcggactcgcgaagagttcaaggacaagctcaagcatcacaacgctgagttgtggcaagggtataccaaggacgattgcttgatcgaatacgacgggctagaaggtgtacctaatgaccgaatcctgtccatcatggccccaatcaccattgacgtaggtgacccaggtcgggaaaggtccgaggtcgtacccaccagccgatacagcatccccgaaatcctcgaaaaactggagaacatgcaatgaacaacgcaatccccctgatcggtgcagatcccgaagttttcgtcggctacgaccgtaatccccagagcgtcatcggcttcatcggtggaaccaaggaagaacccttggctgtagccggtggtgctgtccaggaagacaacgttcttctggagtacaacatcgacccggccagtaccaaggaagagttcgtggagcgtatcgtctccgttcgactccttggtgcccagatgctccaccccttcggcatgaacatcatcgagaacctgtcgtctcacctgtacgacgaggaactcctccgcagcttcggcccacaggcttacgtcttcggttgcgagccggactacaactgctggactcgtcgtcagaacgtgatgccgaaggatgcccctccgaccctgcgcactgctggcggccacgtccatatcggcttcagccacatcgagcgagtcaccaaggctaccacccgagaagtcatgcagatgtgtgactacctcctgggcctagcctctgtcatcctcgatggtgacacccagcgtaagaagctgtacggcaaggctggtgcaatgcgctataagccctacggcggcgagtaccgtagcctgtcgaacttctggatcttctctgtagacctgaccgagtgggtctatgaaatggcagtacaggcttacacctccaagcacctcctggaggagtacaagtccatcgtatctggcgatgaagtccagcgaatcatcaacgataacgacggcgctgcggcggtagctgcacttcaagcgctgggggtgaagtatgaatgacctgaataatcgccatcggttggccggggacttcaacatgtactactcctccacctatgccttcttccgggttgacggcgagcctcgggtagtgtacgtggacgataccgagtccattggtgacgaccgtcaattcgacgggtttcgtctcctgggtaatgtgtatcgccctgacggcagtaactactacggtggggttgtctacagcgaggtagaaagcgtgcggccctccagtgggtactatgacgtctttggccgtggggttcgtgatacttatgtatccttcctcgtgaacaatcggactcagcgtaagggtgtggaccccaggaacatcctgctgaaccatgctcaacaggccatcactggcgaaatgatgatccgaatcttcacccaggccgaggaaatgatctctgccccatcccaccgggacttcttcatcaaggatggggtagttcactggaagggggtgaaggttggtcagatggtagatggccgactgtccgcagatgaacaattcaagaaccaggaggacttgctatgtcagttattggcacacagatagggttccgtaagaaccagatcattgccccggaacatcacgaggaactgcctgcggttgcttccttcgggttcgaagtcgaactggaaggcctcaacaactggccggaagtggacgggtgggatctgaagggtgacggctctctgcgggatggtatggagtatgtcttctccggtcccgcctctggccagaaggcaatcactcgggttgaatcctttgtgagtgcgatggaggaaactcctccggcccccaccttccgttgctccacccacctgcacatggatatgcgggacgtagagtggccggtttatgaacgaacggtcctgacctacatggcattcgaggatgttttcttcgatcactgccagccgtatcgtcgggatagtaacttctgcatcccgttcttcagcaacgactggctggcccagaccttcggtcgccgtatcctggcccaggaaggtgaccgagagaaagtcttgggtcttacctcctggccaaagtattcggccttgaacctccaggtaacccacaacttcgggtccatcgagttccgtggggcccatgctctcactactcggcaggaaatggtaggcctgatgcagcgtatgttgtgtctcaaggccttcgccatggctcacgcagaaaccccgctggaagagttcctcaaggtgctctccgaggtgaatctccgtgatgtattcttccttggggtatctccggactatgaaatgtctccgggtggtcgtgaaatggggatcgccagtgctactctcgcggtagcaaccatgggctttgttcgatccggggtagaccccctggaggatgaacagaaccgtcagcgtcgtctccgggagcaggaacgtgagcgccagcgggccttggatcgtaggctgctctttgctcgcgctattacctcacgactactagatggtgcagcagagcggtacaacttggcaatggtgccaggtacccaggttcgactggatacagcgatcactgcggtaacctctctgcgtcgtattggtcaccaagtgcgtgtacgagaccttctggaggaccaagaggttcttcaagatgccttcgtactgctcatggataacccgcagcaccttcagcgccataccggcgtaacaatcgaaccagatatgtactaaggagaaatacaatgtgtggattggtaggcttctgtgccacaactaacgcgagtgataacgaaatcgctcttctcaaatccctcctggccgtggatattatccgtggtgctcacgccaccggtttggccaagatcgacccggttaagaacgaggtaggaattcacaagcgggcagtagatgcctacgacttcctggctgatcctgaaaccaaggagttcctggacaagggtcgggctcgcatctacctgggtcacaaccgttacgccacgatgggcgacaagacggaccatgggaatgcccaccccttccaggtagaccacatcaccatggtacataacggtactgtagatacctggggcctgcacctgctggatggcaatgataagtacaacgtggattcgaacatgctgtgcgctaccattgccaaccacggtgccaagaagacgttcgaggagaagttctctggtgctgctgcggttgtctggtgggactccaaggaacgtagcctgaacttcatccgtaacgaggatcgtcctctgttcatggcggttaccaccaccgggaccatcgtatgggcatcggagcctgggatgctcaaggttttcctggagcgacccaatgctaagatccgcctgcgttctcccatcgctgaactgaaggccgaagtcctggtaaccatcccgttcacggaggccggagtgcgaaagggtgcagaaccccagaccactccggtcacgtttctggacctcccgattcccgaaagcgaaaggcaagcagcggcatggtggagtcgctacgtcggtgtctcggactacgatgactacagccgaagccaaggcagccaagcgggaacgaaaggcagccaagcgggctcgtcgtatggaacgtctggcgatgcgtacgcaaggaacaccctccggatcaacaacaacctcgacgcagcaggtagcaccttcaagcaccggcaactcgtcacctttgatgttgtcaagatcgaagcctacgcaaacggaagcgagtacggaactgtcactggaatcgagcgtgaagaaaaccttctcatcgaagctcatggcatcaacgtctccaaagtccacggatacaccgtcctccgaggtagtatctccaatgcctacttcatcggccaagaccgtgatctcaaggttactgtcgaggatctggcggtaagctgcctggacccaaagcatcggccgactcctggggagactaccccggttttgaggattgggacgatctcctcggagacgaaatcccattctaaacccagggttcaagtcggcggcacctcggggaacacccctccggccaacatcacctaccccctgaaggtgcaaggccacaccttcaacaacgtgcatgtctttcgggacttcgtgtcccagggatgtgcatcttgcgggaagatcccaaccgcatatgaccagcgtaatcgtcatctgacggtatacgaaggtgccaagttcactggtagcctggatgagtgcgagttcatctgtggtgagtgtgtaatcgaaaataaataggaggtcaaaatgacccaagtaacgatgaagcgtcaagtagtgatccagatggagaccgacgcaacccgtaagtatccattctcccgtgacaccctggacaagatccagtcgattcgtcgagtcaaggagcaggaactcaatgatgccaacccggacgaggaattcctggtaccggccccggtagtcattgcggaagctatcgaccgactcttcgaagactacttcgagtaaggtagtgcgttagtaataacccctggccgacccatgccggttcctaagatgtgtacatgggatctgacttaggaattcaggggttattgctggcttcactactaccctcaacagaaacaggagatatgccatgttctacatctacaaaggttcccgagcttcttccggtgccgtaaatcttcgtaacgccctgggtgctcgaatccttcgctccgagggatctacctaccgtggtcgtgcgggtactgcggtaatcaactggggtaccgttggtgcagaggctcaccgactccgggatattgcccctgtgttcctcaacgacccggcagttgttcaccgctgctctaacaagctggagttcttccgccacttcgaggccaatgctccccacctgattcctcgttggaccgagcgctgggaagatgccttgggtgtactcaatatctctggtcgcatgtatgcacgtaccgatctgaacggccatagcggtcgtggtatccatctggtgtgtactgtcaatgatgcagaagttgctgcgatcgatgctctccgtagacagggccactacccggtacacatctacggtcacacccacatcccggatgttatcaccagggcacaactgttcacccagggaatcgtcggtaagcgtaccgagtttcgagcccatgtgatccgtggggaagtagtacttctccaagtcaagctccgccgtgtttccaatgaaatggtgaccaacgaaggacaaagcatcgttcgtaacgtagctggcggctggatctacggggttaacgatgcaatggaccgtgatggtgctgagcaggctatgtcggcggcggcagaagcaatccaggtggctggactggacttcggtgcagtagatatcatcttccagcacgccactggccgggcctttgtcctggagatcaacaccgccccaggtctggacgctgaaggcagcgccctggaggcatacgtcaagggcttcaacaaaatcttcgaggagactatctaatggctgttcgtgttttcgtttatggtactctcctgtctggtttgtacaaccactaccttctggaaggggccgagtttgtcggcaatgctgtatcctgcgagcggggtctgatgtactccgctggcggcttccccatcctctccttcgcctcccgcgctgatctcattgtaggggaaatctggcaactccccgaaggtgagaagggggaggaaatgctggagaacttggatgccctggagggttatcctggttggtatgatcgtaccctcaaagatttccgaatcaatggggaacgaatcaaagccctggtgtaccatcaggatagccacatggcgttggatatcgtccaagatggcgactggaaggcacacctggcaaaacgacaaggagcagtataatgaatgaaatgaccgtagacaaagcagtagaagtctaccgcgataccctgaacaccttcggacaccaagagctacatgcccagaagatgctcctcaaggagatcctgggccttgtcgcctcccaacgacacctccaagattccatcgaggtctccaagatcccggaggcctcggatagtcccgagaccagctatggtgggtactgtgacgagtctgttggtattcgcttcatgtgggagcgactgaagaagatcgaggatcgactccgtgaactggagaaggtctacggtactttcgtaacaactccttacaagaccctgccgggtaacgtcaatgctgtaccgagcttggtactcaagagccagatggaggaataagtgaagcagatcatcggtgatacggcttgtccgggttgccgagctaaaggtggggataaaacaggtaatcacctcatcttgttcgtagacaaggagaaaggtacccgcttcggtagttgtaaccgttgcggccactatgaagttctcgaagaagggttcaaggttcctgaacgaagggagaaatccgaagaggatatcatccatgaagtcaacgaagtccttgagtatccaactaaagccctcgatactcggaagatcagcaaatcaatcgctgaacgatacggggtacgtgttggtctatcacaagaaaatggtgaggacgttatcgagcattactatccacgcacccgcgatggggagtaccgagcgtttaacgtccgaatcctagaccccaaggctttctactatcgtggtagccccaagggtggtgttgaccccttcggttataacacccttcggcataaggatatgggccacctgcggttagtcatctgcgaggatgaactgtcggcaatgtctgtggctcagatcatggagtcgaagctgcccgagaagtggaagcatctgcgtcaggcagccattagctggtcctctggtgttggttccgctggacgagatatcgcattcctaaaggaatctggtgtactcgaacggttcaacgaggtcatctattgccatgatgctgatgacgagggtcgtaagtcagtagagaaggtacgtgccctgtaccccgagtgtaagtttgtagagcttcccctgaaggatgctaacgacatgcttatgcgtaatcgaggggatgaggtctaccagatgatccgattcggtagcaaggttaagtccccggactgttccgtaactgtcgatgaggtatacgctgaggcgctagaaccccctaagtggggtaagagctatccctgggaaggtctaaccaatcttacctacggtcagcgtgatggtgagatcatcggggtaggtgggggtactggcatcggtaagaccctgttggcccacgagattgctgcctggaattgcattgagcacggggagaacgtagggacattcctgttggaagagcaggtagccatgacactgaagaatatcgcggggaaggtagctaacgtacccttccaccgaccggatatcgagtgggatgagcaagcctttaaagacgctgcgggtaaactccgtggcaagctcttcatgtggaagaacaagggtcagaacgattgggatcatatcaaggaatgtattcgcttctgggcagtagccatggatgtgaagactatcctgctggataacatgaccgccatgaccaaccatcttagtccttccgaaatgaacacggagatcgcccgtatctgtacagagcttgcaggtatggccgatgagttgggtcttcggatcttcatcttctcccaccttaacccgcccaagggtaatcgtacccacgaggagggcgctgaggtaaaggaaagccagttcaccggctcacgagctatgcagcgttggtgtcagcttatgatcggattcgagcggaacaagcaggctgacggggaagagaagcacgagagcagaatccgtgtaatcaaggacaggaactacggtaatactggcctagtgtttaccaagtataacccagagacgggtcgcttggttgaacgtgagggcagttacgacgaggtacctgctgacgatgacaccccaatttgattacgttatctatgacctagagggggacggcctcttcaatacggtcacaaggctttggtgcgctgttgttgtagacattccgactggggtagtccggggattccggcccgaggaaatggatgtgttctataggatcatcgcccatgcaaagttcgtagtcggtcacaacatccttgactacgacaaccgggtccttgagaaacttcatgggattatcatacccccagatcgaagctatgacaccttggttgcatcgaggttgacttggccagataggccccagggtcattccctgggagcctggggtaagttcctgaagtgtcacaagggtgacttcaacgacttctccaagttctcagaggaaatgtttgagtattgccttcaggatggagtggtcagtcacgcactgttcaactacctcctccgggtactcggcatgacttggcaagagcttgttgaatggaggactgtagattggctaaaaagcgagtgaggaactacaagcgtgagagagaactggctattcgacgcggcgaaacgggcgtgggctctaagtcaggagatgctcagcgacaccgagcccgccgaaaggtggaaaagcgtcttggcaggaagctcggaaccgacgaggttgtcgatcatatcaaacgtgttaaagatggtggcggtaacggggattctaaccttcgcgtccgtggccgttcttctaacgctgctgatggtggtcgggtgggcgatcgtaaagccaaaggcattctcaagaaaaagtaaatgaagaggggccttcgggcccccgaggactcactatgttcaatcgaaagcttagcatcagcaacatcctcagttccttcgacaaggtgctggttaacctgaagacctttatccaagagtcttcggaggaatctgaacggatctacaacgagatcagtctcctgaaggcggagcgtacccaggtcatgcaggacaatctgaaggcccagaaggtactggctaatctggaagaactgctgggaggtaagagtgaagaagtatcgagttaacgtggggttccaggacaccaaggtgttcaacgcagacttctaccgaatcgagttggatatcatcagattcttcgctggtgattccgatgccaaccccatgaccgtccgagctaacgagatcggtgctgtccgcggatgggtttctgtagaggagatcaatgatgaccagtaagaaggaaagcctggaagagcaggcgcttaaggagatcgccctggagaaggaattctctggtagctggggtggacccgagatcgacgctgatgacttccccttgggtagtgcctgcggcctagaccccgaggtatgtgaatcttgtcaatagtcctacaagtcctagtcatcttctggagtgcattcttccaggtgttcctcctgggtctgaactctaaactccttcgggatgataagatcaaggctgggtttgtagtatcttggtgtatcacgctggctcagtttgcttacatcaaggcggtagcctcctcccacttggagatcggatggtttatcttcgtgtccgggtggggaggtgcccttgggattacctctgctcaatacttctacaagtggtacgacagggtattccacaagaaggcttgacaaatccagaaaagtgtggtataataaccttaaggtgtccggggttgctttacccctataggagatacaaatgagtgaccatgtaagctattccaaacatgtccgtggcaagtacctgtgtaatatggcctctgccctccataagagcatggaaatacaaaggactaacatccggaagttcctcagcagtccccagattactctccgggagaagcgtcgggtattcctgagcctccccgctggattcctgggggtgagctacttctcaggctcccacctggatctgagttcctactcgcctaaacgcaatagccgggtacgggagaaggatctgagcctgtacgacgacttctacatcgacaggaatacccagctagatccgcgagacctcttgtttacctcccaagaagagaagaaatgggagtttaaatacctgaaggagaggcggggtgatgggttcgagctatccgatgaagaactgagcgacgttaaggatatccagcgcaagattgacctgtcctggtacctggtagacctggcctgtgagcgtgggtgttcctacttcattttcgactggtgattacatgagcaagatcaagagtattctcatggagcggatagatgacttcctgctcaaacaagttgctgtagccttcctggagcagcaatggaagttggaccgcagtggtaccgtggactacctctcctacctggagggtgtatcccacgaagctgtggagacagttgtagagaatctggcggagcgtcttaagggggattaagtggattggagaaagtcactgttcgttgagcacaaggtagctgatatcatcagccgccagagtaaacgtggagtctacttccagactcagcgggccaagtggctgatccatgtgcttagcgaacgaatcctcaagattgaccttgaggctgtcccccagatgcccatgatgatcgtaagggctggggccttcagcaagccattcctaaagagtggtaagccgaaccaaaggctccagtccctgtggcaacgtcttgggcacttcgaggtatctggtcccttctctgcaatcgagtatgtacccttcgaccttggtaagactgccaagttcaaggactggatgctggatcagggatggatacctgaccaatggaacatcaaggatattactgtcggcactgatggcaagaagctacgtggatctgaccttaatgaatccttgaataagtacattgaggatctccgacagagcaaatctggacgactccgaatgaagctccaggggatcatccctgggaaaactaccattggggaagtcaagagaaagctcgaaaagcaacgtaaggtcctaacgactccgaagatgactgaagagtcgatggataccgtccagggagacctgggcaagctggtgatgcagcgaatggtttgggcccaccgtcggtccctcttgcaggggctggtagatcaggtgaggcctgatggacgcctagaggggagtgctaacccctgtgcaacacctacgggccgcatgaggcaccgtgtagtagtcaatatccccgctgctcgttctcctttcggacctgaaatccgagggttgttccaggggacacctgaggctggtgaatggaaatggactgtcctccgccgtgatcttggggagaacgaaagggttaggcccttcactaacatcgtggaggaactcaagaagggtaagtggaagactgtaggaaagtaccgggtatacgtcccagcgaatcaattggtattcgtgggctacgatggtgctggtctagagcttcggatgcttgcatcctacatcaacaacccagagtacaccaaagaggtggtcgagggtgatgtacacacggccaaccagatagccgcagggcttcccacacgggacgatgctaagacgttcatctacgccttcatctacggtgctggggatgccaagattgggactatcattggaggcaccagggcagacggggctagactccgggcccagttccttgaggctaaccctgaccttgctgcactgattgagagggttaagcaggaagccgagagaggttatctcgaagggctagacggacgaaagctaaccatgcgacgttctgagtctggcgacgtgatgatccataaggcattgaacaccctcctgcaagcagcaggtgctattgtcatgaagtgggcaatggtactcctggatgagcgagtccgcaggttaaacctgagggcttggaaagtcctggatatccatgatgaaggtcagtgggaatgccacccagaggatctcattgctctacgtggacagatggaaatctgtgtccgggacgctggagttctcctcggggttaactgtcctttggctagtgattccatcgctggtcgctcgtggtatgacacacactgatacatctgggggttgactttcagccccctttgtggtataataccttcttccctacgagaggtttaagatatgtctaagaaagtatcccaacgattcaccttcccggtagcgaagctgatcttcccctacatcgtaactccggacaccgagtacggtgaagtctaccaagtaaccatctgcattccgaccaaggaagaggccgacaagctggtacagcagatggaatccaaagatgcccgtctgaagggtaccatcaaataccaagagcgtgatggcgagtacctgttcaaggtcaagcagaagaagcacgttgattggatgcaggatggcgagcgtaaatctgctgtaatgaagccggtggttctgacctcggataacaagccgtatgacggccccaacccgtggggtggttctactggcgaggttggtatcctgatcgagactcagaagggtccgcgaggtaagggtactatgacggccctgcgcctccgtggtgtacgactccacgagatcgtatccggtggtgacggtgaggatgatccgctgttcggtggtgccttcaccgaggaagagcccgaggatgtattcgacgaggtattcgatgacgaagacgctcctatctaagggcttggaggatcacgaggcgggggtatgccggtcaggctgcccctactgcttaattgaattcgagagagtgtggggtgtacgggtggtgagttctacagctgcatctaataataaagtagaggtcgatcctaatggaatcaaacctggtgagccgggcgctaagctcgatagcggcaaggtggatgttggaatcatcttcgaagcgttcccgagggctctatatgcagtggcacaagttgctaacttcggagccagcaaatatagtcgcgggggttggaggtctgtcgagaatggtgtccagcgatatgacgctgccttcgggagacacctccttgagcgacacaagggtgaagctttggacccccaaagtaaactaccccaccggtatcacgaagtgtggaacgccctagcgtccctggaactcgtcattcagcaagaggaggaatccaatggaacttctgttggacccaagggctaagactgttcctagcaactactctgtgattggcgtcgatgtagacctggggcttaccccaggctacagcctaacggaggaagctatggacaaagccaagcgtcaagagagcgagtattacgactggaaggggtatgaagcactggccaatccagtggtagagcacccagagtaccgagccaagggtgaagcctttgccctccgtgtcttctgggaagagaagctcaaagaatcccaggtcgtagaagaggtagcgtgatgatagctggtatcgatggtgacgttcttaggtatgagctaggccacgtggctatgtcgaaggaacacatcttcgatatccaggtggagaagccatggcctgaggaagaggtccataagctcgtcgatgataaagtcgaacaaattatcaaaagggtaaatgcagatgagtgtgaaatctaccttactggccaaggaaattttaggctggagcttgcgaaaatcaagcaatataagggtactcgaatcggtcttgaaaagcctcatcactgggaaaccgtgtcagccagacttaaggacaagtggggagcaatcactttccacggtatcgaggctgatgactggctcgggattcgagggactgaagagggagataactttacagcgtgttctagagacaaggatatccgccaagtcccaggatgctaccattacagttggccctgtggagattcccagccggagttgggaccatttcaagttgatggccttggaacagtctccgcttcttggcgaatgtatggtgttaagaaaccgcagaagtcatggaaacttgagggcaacggtacggcattcctctacgggcaactccttgttggtgactccgtggataacataccaggcctcccagggacgggaccaaagacagcggcagatttgcttggggagctttctactgagagggatctcttcgcagcttgcgcttacgcctaccaacagaagtacggagataattggaaggagtaccttgtggaaaactttcgtctcctctacctcattcgggaccgctcttggcttgatattcagcagtccggtaacgagtatcactgctcactgaagaaacattgggagattccctatgacgatgaagaaatattctattgatgaagcacagaggatctgtgaaggtctctttgagatcctcgaaggtcttggcttcactgactacaaggtcgctggtggtttccttcgggatgcagacaacggggttgcacccaaggatgtcgacctctatgtccgtaggccatacgtggaggaccctactgatactcgccgtagccggttcggcccacggttgatccactgtgatgatgataccctagaagtagaggtcactcggttctacaacaagctgggccacaagaaggtccggtgtaggactggagataagcctgatgggtatcctgcggggtttgatgtgtgggaatctattggtgttgacctacccgtcaacctcgtcgtgactacccactcccacccagcagagttcgatgtaggactatgtgagatcgcatgttggcctgtaaatcggttgggtttgaagtctcaaatctaccgcacaaaagcttatgagtttgataaggaagagaagtgcattaccctgaaccgtcttctggaccctctcctggatcattctcaacccctaactgacaatcaagttgaaaaggttgtctctcatatccaacgtatcaaactgaagtatccggagttccgggtgtgtctaggggattgggtttggctgctgatccggtctaactctgtcctcactgaggggacgctatcggttgtccgtaagcttcaagaaggagggctcattggcaaagcaggggagattcttcagacccaaactgaagtcattgattgggacgaagtacgacagcgaaaccgagaagatcgtccacgagacgatgccttggatgcagttcaagccggagccggtaccatacgtcatcgaacacaagtacaagccggatttcaaggtatcgaccttacaaccctgtggatcgacgaagcatctgctggttgaagtcaaggggtacttccaggaggcctcggaggcagccaagtacgtctgggtgagggaggctctccccccagatactgaacttgtgtttatcttcgagcgacccaacacagcttgccattggctttccaagcgtaaagatggcacaaagcaatccatggcggaatgggccgaacgtaacggattccgctggtttactctagagactttcaaggagtccttccctaatgagtaagaagtataatgaagacactctcgtcattgcggacacccaagttcgatccgaggtcaacatcgatcacctcgggaaccttggggagtggatcgcacgtaaccgccccaagcgaattgttcatattggggaccattgggacatgcccagtctgtcaagctacgaccgtggtaccgctaagatcgaaggccgccgagtcctctctgacatacaagctggtaatgatgcgatgcgagttctgctcgatcctcttcgccgcctacagcaacaccaagcgggttgtaagaagcgtatctaccgaccagaaatgcacttcttcatcggaaaccacgaggagcgtatcaagcggtatgaaaattctaaccctgctctccaaggttttattgggtacgatcattttgatctgtccgattggattgtccatgatttcctcgacgtgggtgttatcgaaggtgtcgccttcgcccactacttctacaatcccaacagtggtcgtccatacggcgggagtgccgagcatcgcctcaataagatcaagcgcagcttcgtccaaggccatgagcaagggttcaagtaccacatcgaggcagtaggcaagaagcgaatccacgggcttgtagtcggtagcttctacacccacgatgaatcctacaagggtcctcagggtaacgaccattggcgaggtgtagccctcctccggaaccacaaggatggagagtacgacctcaaactgatgagcgtggaggagttcctgtgagtaagttcttgccagacctgtactacattaagtctgagcatgacttcggtcaacgggggttggcgtttaagacgccgatctccgcagaactctggctggatatgaagtttggtaaagggggtgcagaggaggggcttaagcgtgggatgtataccatcgaagtcctggagatcctctacatccccagtgttcaccttccgaatatcttggggtaagctatgaaagatcgagttggacgtaagctagaggtaggggacagtgtagtcttcctggtccacaggaacacctcctcccatctagccattggcaccgtcgatgggtttacccccaagatgattcggatcaaatgcccgaccatgagttggactattgacgctgagtatgttctcaggagcagtgacaaggtggtgtactatgacaaaggctgaactggagaaagcacttgaagagacgcaaagcgctcttgcgaaggctgaggcgaaggccttttcctttgaagaactggctgaagaagctaaaagacagattgaattcctcgaagggatgctagacctagtagacctgagggcttctgtattctacggagattggaggggttatgcagaaagatcaaaagggtaagggtggattcccttggacctacattgcggtagcagccttgtttgccctgctggtttatgtaggatatagctgactgatgttactcctgaccctgggagaaatatccagactcctcatcgatgtattatcttgggcaggttcactgtaggtatccatcgagtaaccaaaaaaaggccccaagggtatcatcccaaggggccttatctttagctccggagagcgttcagcagtgtgttgaacttatccacgagtgcctcgtgagtatccgtataggaagccacggggatctcagatatcttatcctggatggaagccgcaatggcttcatataggccactcacttcgctagccttaggcttccagttacctggtttagcctcactagccttagcacccacctccagaagcttaggcttcccctcaatatcctcccacttcactggctcaaagtctttcgggccaatgacttgtcggagggtcccatcctcattacgaacagcaatagccttcgattgaataacgaatacactgttgccgtcgttgtcagcgatataacctgccataatctaactcctaattaagctgccgatttgaaggtacccactgtaccaccgaaaggatacactcggacagtgcattccccaaattgaccatcagtctccgtctgattacccttagcataccaagccttgtccggagatacagcgaacttgatcttagctgtagacccttggataaagtggaagtgacaacctggggttacatctggaccaagagtcacggtgatatccgtggtcccttgagacatgaagaaccaaccagactgctgcttagtcatggtaatgttctgagtaagctgctgggtgttgacgacattaccaccaaggtgagtagtcacgaggcgggggtccaggtagttctgttggagagaaccaatgttcttcacaggaccacgcatgtcatcaaactgctcgataatgtaatccccaatagtaccaccgttctggtcatccgggccaatcacatgcttaatagccacgtaaacacccaggtgttcccgacggggatctactcggaattcactaccgaaggcagtaccgcaaggtgcctcaatcatagtctccgagaagaggccaatcacgtggccagggtcacggttaccacccgaggtttcaccaggagcacccacaagggtgttgaccaggacagaggggataacggcctctgaggggttcttcgggaaggaggctgtaacgttctctactaccagggctgcgttctccttaactgcataatagtcagggaggaactctgtagcggtaacgatgttagtatttacccgaccggcatccgaggtaatctcaatgagatcaccatcggaattacgtcggaagacttttggcacatcaaccacgtaggcacggccaccaggaccagcggcatcagtttctacataagttgccatattacttctccttaaagatccagagcatcttccatcgcttccataccggcaacgaaaggacgtgctggagtttgcttatacaagaacttccagatttcacctgcggatgggtcatccccaaacgaagcgatagttttaccaacagccatagcaccctcagttgcagcaccagctactggacccaatagtacctctgcgggggtagtccctcggcggtaacccgttagcatgtcgtagatcatagaagcctggagtggcatctgttgcatcactacgtccatcatccgttgttctggactacgggtatcctctcggctagacccaccgaacttagccagttgacgaagctcatcctggagataccccaggctcatcatcagaccaagagtgaaggctacacctgcggcacccataccagcgttggtccaagaaccagcgaagtgtgggctcagtcgtctacggaacatcggtaggatgatgttaccataggctgctgggtaacccttcaagagggagaacatctgaacgtttccgttgctcatccacataggcttatcagcgaaggtggggtcgaggactacctgatctacaaaccgacgcatggccaaggtcttaacgttgttagccatcaggacttcagatggggtagccggggagatcaacttgagggcatcctgctggctacctatgttaacccccatttcccgaagctgagcaaccttcagagcgccattggcagaactaaaggggagccctgcggctagatccatcaggttgttctgatagaccctcttggcagtctctgttgcaaatactcggttaacatgggttaggatggacaagccgttaatgaggaactgaccacggatcgtcttttggatagtagagttaaacacctcagcaccaacccgatcagccatcagagaggtagcagaggccagggtgtggttcatatcactcataaaccgaccggtctcagacttcggaatcccactgtagatcctgcgggctgcttgccttactacctcacccatggttgggagtacagccccaagggtaggcataaccccagccttagcgaatggtaggctgaactcggttagggtcgagaagccggcgaggggaagtctggagagcacgagggcacccgacgtaacagccgctagcttcttaaggttaggatctttgatacgaccgtgcataccattgtaggcatccactagatcatacatccgatccacctcttccttagtaacccgcttaccagcccgttgagcctcagctacagcagatgcaattttagcgttagccttctccccgttgataccaaaccgttcggtaaaggcaatccggtgggaagccccttcgaagtagtcccggatttcctggagacgcttcttaggagtatcgttcagggagtatttattcaggatctcctgaggtacagaaccaaaggcccggctctcttccagttgaccatacttaggaactgcatcgctttgggcaaaccgtccacgtagagtatctggatcaccttggatacgataacgagggtctacttcccaagccccggtctgctggttctgagtaaccagtcggttaacctcaggggcagtgttaccacgagtatcatccgagacttctaccaaccagttggctacagcatcttcagcagcttgacggttctggaagtacggagtaatatcattcaggaactcgggggtctgaaccttctctggggatagaccgaatggcatataatttgggatagtaccaacggacatcccaccacggttaacagcctcattccttacgtcatccatcaaagcacggagacgggtagcttctggggtattgacacctgcggatgtatcagcgataatcctatcgatctctttggaagacttaccctcaaagatattatcaagttcggagttccacttacctgcctggagttcctgatcctcaaagatggtcttaccagaggctcgcttaccactcatatcagcacggaaggtctcagagaactcacgagcgataggagaggccttggcgagtggctctaggagcgacgtagcttcgtttcctagggcatcccaggctttcttgaccgtacccctaggctctagctcagacgccttaggaggggccgcaggagcattaggatcaacaatggcagagccagctgaatcctgatgacgacccagggtgtccaaaccagaggatacagcaccaccagcagtacccatagctgtaccagtaaaggcagccgtcaggaggttatccatgaactgctctggggtttgtacctgccctactgcatcataggcgatggtatcctgtagggcctgctgggcaccagaggtaacaccttcagccacaccagagactgctgcatgcttaccagcctgggtaacagcctcgatagcggtttgcttaggtagtcccgattggaccaacatctggtaagcgccatctttaccgatgtgcttgaggagtggggcagcgataacaccagcacccgcagtgtctagtaccgagaggccagcaccaccgaggactgcggtccatgggttgctttgatcggggtctagttccttcatctggttactcagggcacctacgttgatacccatggaactcaggaaggaaccaatgagcgctccacccatacgaccaggggccccaaagacagagccagccttagcacctgcggcaccaccagcaagtaccggggccatcgaagggagagcctctacgatattattcttaaggaacgacccgatggatgggatatcttggatatcagcgaaagaccgaacatcaggggttccgtactgtgacgcttcctgagcattctcctcggccatctgtgtgccgtagtctttcaggtagtcactgccagtcagttcaccaagggtagcaatagtaccaccgatgttagactgcatggtatcaaccccacgaccaatcgcagagctaatagaattagggtcagccggagttactagggcactcaggtctggggcaggctcaggggtagcaggggctacttcctggggtgcctcttcgataacctctggctcattcaaggaagccaattcagcggctacgtcgaggcccttgacctcagccagttccgcatcaatagcggccttcagttctggagaaagagccataagtcaccttctagttgctggaaagagaataggctcttaagatgtatcttaggatactaaccttcttagtaagtaagtcaaaaggaagaaggaatcttaagagcctataggtctattatactacattttggatactttgtcaagtaccttttatcgggttggggcaggatagtccagatcagcaccaaaccagttacccgtaggttgaagcttagcagcctcccgctggataatacccactgggttagccccaggattagcccgaagttcatttcggacagtctgggcaatagcctgttgggcagtcttactcagcttcttaccacccagagcctgagaaccattgacttcactcaggataccaagggcgtccttagtagtaacagcttcacctcgggctgccttagctgctgcctgacgtgcctgagcgctaatcctagcggtcttgagtcgtacagcagaacctagctgggcattctcttgggccatgtcctggccacgtcgagtagtttcagcctgtagctgggcccgttggttagccaggtcttggccacgtcgggtcaactccagattagccctatctacagcagcctggttgacccacttatcaaggacgccctcagtcttacgcttggtttgctcaagggtcccttccttaactttcaggttgccctcaccaaggcgtacatcagcagcatccttagccaccttacgctccagatctttttccttgatctgacgatcagcagctgcggcagccatcttctgctggttgatcccagcctgtaggttacgatccagttgacgctcataggaagcagcgaacatatccccagctttaccagtcttgtctatggccgaagccagaagaccagtaccaatgagagcataagatacataacgagacaggtcatcattatccatagtcctcatctgagtcaactcttcgttaacccgattcttaagctcttggggttttagctctacaccctctctctgggcatcagcttcaactacagcctgggccatttcaggacgacttacagcaccagtacgaagaccctcggctgcaccctgttggatgacctgtcgattagcctcctcctcatctgctacagcagcaccagccgcagaggccacctctggagcgatatcaggctcgatagagggttggttaggggttaccccataggacaggagttcagcccccgtagggcctcctgtggcgttctgggctgcacgttggcctacaccctgggcccattggtttgcctcttgagcaacctcgggacccatgttctcaaccgcttggctagcctgagccatttcttctgcacgagtacgctctgcatccccgagttctcctggggttacagcggcttgtacacctacagagataggaccaccgaggatacctgcgatacggcccagggcaccacgacccgtagcctcagccgcaggggccacctcttgggcagcccgagaccaacggtcagggttctctagggcagcctgagcagcccggcggacacgatcagggattcctgagccctctacagccagcggcagtttgttccttgcgattcgcgccatgtccagttcattctgagcagcccggaggatgctagggcgaattggggacccttcataagccatgctggccataggattaacctccaaatagtttacttaggattccagactttggctgctgtccgaaaccgagttcttctgcgctaggaaggattcccactcccgctcccatacctgctgcaacttccgctgcgcctcgttcgcttgctcctctagccccctcgacagaaaagcttggtactgtttctgaagaaggctcacttccttgcccgaggagagccgcgagtgctgctccgcccattgcgccaaaagggtttgattgtccactagactctcccgattgcattgtcccaaggtgggtggggcggtaggaaccttgacggctcaactgtacccgctcctgcccaccacctatattctgtcctatagcgaacagcttctgaggaagggaggccattagaacagaaggcccccgaccctaccaccagcattcataccaacagaagcacccgctgggccaccgaagagagcacccaaggaagcaccaccgagagcacccagggcagacccgaggccaccaccaccgccaccacccgaggaggtagtaacgttggttccacccatgtcgccggagataagctccttgtaggcgagtaggtcgttaaggctgacgttattctcataggcccacttctgtagagccccgttgatctcctgctgctcctgattctgaagcatactaccagcatcaacctgcatggcattaccagagccgagtcccttagcaatagccgagaggttgcccagggtattcaacctattctggttgtaagcctgctggtcttggaaagccaactgggaggcgttattctgttgattctggagcaatctagcggtagcaataccttctgctacacccgctcgggaactcccatactgaccagcattagtggcccctgctcgcaggtctggacgtaccgtagtgtcgaagtcccattgcatctgctcgttggctgcaccaatggcgttcgccaagccagttttgttgggatcgtaaggaccaaggtaatcagccagagagctaacacctgagctacccaggagagactgaagggcactaccgagaccacccaacccttcgattccactaagctggagagcattctggtcagccaccgggtcaaagttcggatcgccaccgtaattggggtcaaagcctccgttatgtagccaatcactggcacccgagagtagttcattatagttaccttgctgatagggtgtagagacagaggtggtcttttgcttcttgctaccacccttgtaagcccgagagtctagggcatcctctacatcgaaccccatcagacgctttacattaaattggaggaagttcatctggagttacctcacgatagaaggatacggagtcttcggtgtacccgagtttctctagggtaggcttccagccccgacgaccttcgcattggataaaccgacagttaactcgttgggcgaactgtccgaggaagtcgtctacctccgagtaatctaccggggtttcattcccaggcatcttaccactccagaagaagtgaaggatattacccaggggtgcttgggacacttggattacaccagcgtagccactttcttcctggtagaagacataggcctcataattaaccaaggagtgaaccaagtgttcgaagtcccaaaacttaccgaggtccgtcctgttgaaggctcgggccagagcagggactacggtaggaagcagatcgatattctcacgagtaattaaatgaatcatggagtcaccaccagggggaatgtgaatgtacccccgaagactgctccttggggaattccttggattagaacacggccattagctgtgatcttaaacattgcttggttaaccaccccagtctgaatagtagccctgttgagaacatcaaagacttgatccaacggaggtgcgttagggtcagacggaggtggataagtaatagtgctctgcgctgggataatgctggaataggccgggataaacaactcagcaggaggccaatacgcctggggaagatccaggacagtagctccattagtgtagttaccaccagacatgagcatggttatccatacttcatccttagcagtgttcatcctataggcacaggtacccatcggctgatggttgttctgtggggtaaataggataaaatcccccggcaggtccttgggtttagtacctgcgagtctccattggttatccaagtcgtaatgatagatgccggatactggacctaccactccgggggcaaaatactttacagtccctggcttgagcttcttagggggctccatagagaccccccagtagccgtcagctaggtcattaagagtctgtccaaccctaacgaattcatcattaaggaagggcagaagttcctcctcttcctgtggtggaatcgaagggctgtacttttgactcatcgcatacctgccttcggggccatttcaatagtgtacccattgaagtaccaatccccctccgaagagaagtcgaacttcaaggctatataccggcccacatgtttagtgtcaatcttatagtcctgaccaatccggtatgggtaagggcctttccatcgaataccagaaccttgtacctgagcgttacccacccagatgttacaagtaccgttaccagtaatgtgtggaatgatggcactcactgtcttcatcattcgatcatccccgagatagatatcggatctctcaagggtactgacgaagttctgtccagagaatgtagagttattaccgaagaggaacaacttcttatcctggaaagacgagaagatcatactggactttgctgggttataagagccttcaccccagaccgaagtatcggtatcccaggggttggggtcgtcatcccagaggttagacaccttaggatcgatgatcccgtaggctccactgagaacgttgggaaggtctcggatactccaagtgttttccttccagttccagatgatagccctgtcgcagtgcttacctggctcagacctagtggaagagtagcatacccacatttcagtattcacgtggtctgcaagtacgaaggtccgttgatagttgtcagggttaatatccgagaagaagaacttacggacctgagcagcaataacagactgcttctgcacaccgttgtggacatatacgtcaccgtggcctactacaaagtggttaccatcgaactctattgcacagttgggtccgaggatacctacgtcgttaaacaactgctggaactggaagatgaacaatccaccgatataccgcatggagtatacagagtcttccttgtagatgatgaatgaatcacgaagcttcacaccatccacgatagcaccattggtatcagccaaggtgttctgaccagcatccttagtagggtccgttgggtcccaagatgcaggtacaccaccagcatcagccgaggtactccaccagaccatctgtggcatttctacagagttacttgtagcgtttaagccaaccaggaagttcttaaaagacttaagcctcttaaaagtagtattcgctgggaagttagggagtaccctaaaggttgattctgacggtggaagatgatgaggagggttaaccccgtcgttagcaaagattaccccgttgaacgatcctacagaccatctattagttatactagcagcgtaaggtcctggggatacatcgatgattgtagtcccgtcggctagatacaaccgttgttcagaacacaggagccaataggggatgttattccggatgaaaggaaacatatccaagattggggcctgggctgtatcaaagataggcgtatggcccagagccttctgagccttgccgttcttaaaccggacgttgttcccgaaggaccatttctccagtggcaggtcagcgggggcgatatcggtcacaatccccgtagggttcttgacctcttgtctctctagggccattgtatacctcagttcttaatgatgaagaacacagaacagaacggtgggatattacccaacggcatgttgatctttactgcatggttgtgagtctgaccttgaccagcagggccagtctcaaggttggtattggctgcgttaccagagccacccgtcagagcaccagagtcgcccgcagaaccggttagggtagtagcacccctagttctccaggtgtgggtgtgtgatgggatttgggctagggtaagggcagtcccttcagtgaacccatcccatacaatgttagcgctaccacccctagtacctacagcctgggaagaaccatcgataccccaggggaatgcaccaatgaggttggggactgggataccattagaggtagtccctacaccattacaaagcttccaacctgctgggatctgagccagtgacccagcccacatgataaccatcccaggtttaacatactgggttgtatcagcgactgcgtttagctgggctgccgttacagtgacagcctgagaaatattggggaaggtatttttaatagcactcttaatgagtcgcaggtggtcatccccaaaggacttcagatcagagccggtagggttcgtaggcaccaactggttaatataagttgcgacctcaagacccattcttggcctcctttatctcttctttcatttcttttcgggtgacataccgctccccaaagattgccatagaaatctggagatcgctcaccgcttgggtgagcttctccgtggcctggatgtttctttcaagcagagcctgatgaacattctgaccgacaaccgaggaacctaccgtcactaccgaggatacgaccagggcactgacgatgctgcccaggttatcagttagaagttgcatcctccgtcttctccttaaggttgtcttccaggacttttacgaactcgtcgtcaaccttagagttagtcttctccgccagagccttagcaccagtcacgatggacttagcgattaccttggttgggaagagggtagccagaaggttgattgcgagggtttttagaaagataggcatctgaatctccttaacgttcaatgtctttgatcgccagtcgagtgctagcgaagtcagcggcattctcctcgttctggagttccataacagcccgttcgagtttctgaccccagaactgggaccgagcttcatccatggtgtacagataaatctgctcaaggacaccatagagataaatctgcggatacttcgtcagagcccaagtcgttgggttagcgaggcttagctctgggagtacagtccagtagttcacaatgaacggggcaccgtcaggaacaacggggaatactcgccagaagttacccaaccgagtgtagtaggttacaccctgaggttggtagttgtagttaacataatgggtgaaggtatcctgggtgatgtactgaagagtacgtccaccgataagggagtcacccgtgatagatcgtagagcaacaaagtgctcaggtatctcaatgccaccaccgaaggccattagggtttcgaagtgttcgttctccctcacccgtagcaatcggttaagacggtcagtggtattaccaatgaacaacatcagaagttcttgggtaagatcctgacggtcagaccactggatagcggcgatagcgagatcagttacgttgttgatcgtagccattcattacacccgtgcctcagaggtccgcatacgatagttgtctcggtcgttaagccaacgggtaaatcgagcggcatggtctgggtcacaaccgatcaggttaagatcgatgggaccaccttcagacatggggcgattccgtagggcctctacaacaaccagggggatacttgctaccttgcgcatattatcctttcggttactgttgacacccgagtggcgctcttctgcgttagcggacaggattgactcaatatcttgagtatcctttcggataaagagcccaaggtcttcgtcaattgcataagtcgattggatactcatgatgtacctcctaaggggaaacaaagggccccgaagggccccgttgggttagacctgggctacgacgtcacggatcagagcaccggacttctcgttgttaacacgcagggtgtattcaaccagcagttggcgcttctcgctgtcaccggtcttagccagttcgtgctggaagaacggacgcaggtagcagagggcgtgcatcttcggatcaaagatgaacatggtgttttcgtggaaccagcggttagcacgaatggtgtacttaccgaagtcactctcgtagacatccacggtctgcgcaatgcggttatccgaggcatccagggtgatctcagttgcacgacccttcatgttcttgctgatggccttcttgatcgagctcgaagtctggatcgagttagcctgaccaccgttgcgccagatagcctcagaggcattcaggagcatgtcttcggtcagaagacggaggtcaccagcggtaccagtgtcggaaccatcaccagttggcagggtaccattagcacctaccgaaccgttggtcttgtagtaggcaaagatgtttgccatctgacccggagtagtggtgttacgctggatcttagcctgaggggcaccgaccatggcgtattccatgtccagcttcagttccttcgacttcttagccagctgatacgccagttcgttcttacgaccagccttcttgaccttatctgcggtaccggtgacttgcagggtctcgtccgagatttggcagtagttgttcaacatggtggtgaagctaccagccttgatggttgcatcctcaccttcaactcgggtgttcttacccggctggcggagttcatcagtctgccactcgtgggtgatagcggtagctacgcccttgccgatagcagtcatgaacggggtgtcatagggtgcgatgttgtagatgatatcgataaggtcttcgcgcttaccgttgatctctacagtcgagacggcattagttggagttgccataagttacgtttccttctattagaaaatatcgagagaggagaagagagcagcagcggcttcaaccgactggtctttcctcagattagcgcgggcagctttaacccgcttagaaccctctgaggcttccgccctacgagcagcaggtttaactgcggcaggtagttcagtctcctccttcttctctagggcagccttgcgacggacctgagattcagcccacttacgtgctgcatcgagtacagccagttggcgggcatcagatatccctcggatctcatcctcggagtatccaatcgatttgccgtaggacacaatcttgtcaccccaagactcatccgtagtcatttccgggataagtttcttggctagctctgtctgacgcttaacgtaggcagagtggacaatctcggctcgcttctcttgcatagccttaatgtcgttacgacgtttgataagagcctgggctcggtctcgggcttccagggcttccagtcgaagggtttgatacttctctggatcctgggccttaagctgctcccagtttacattgtcatactgattagcaccagcaatagcggtaacagcgtactgctcaagctcggccagtagattagagcgttcagcatcaagctcttcgaatttagccgcatactgatcctctagttcagcctgtcgagttacaaactcttcattgcgaaggtagccactcttaagctcttcgaagttaacctcgtagacttcatccccaatcgggatctcgaagagtttatcctcaggatcttcctcggactcaacctcgggatcttcctcagaaccctcttcttcctcctcggactcaacctcttcggtgtcctctggagtaccttcgtctactacctcttcctcctcttcttcccctacgactttaccatccacggtttcatcaccgggtgccaggaggtcatcacctagcaaatctccgaaggcttccgctgcctcgaattcatccatgccttgattctcaaggtccattacttatactcctttagagtgatcgaatccaggatagcctgaatacgaagttgtacgcggttgagggcatgtagttcgtggtagatggcctccctggattctgaatccttaggtgccgtggacttccactctccctcgatctcttcttggacaatacggaaaagctcaggaagaacgttctcacgtaccatctgttgtgccgcatcagtcagcactagactatagccaaaacgttctcccaagattatttcctcactgccttagatggcttcttagtctcaggtactttaccgtctccgatataagcagcccgagcctgagtagcctcaagatgatactccgcttcgttacgagcccgttcccaagtgaaacgatcacgctcaagttgtagttccgcttccttaagggccatttctctctgctgaaggacagcctcttgcttcttcagttcgatctcggccagtcggatctgagcctctacctgcttcatctgggcctccgcttgcttagccaaggcgtccgattgggcacgttgggcatcagcttgggctttgatatcttcaggcttaggttgtgcttccttctgctctctgatggccttagcccgttgagcttcaggagaatccgggttagtccagaagcgatccgggtctttgtacccagcgttctctgtgacttccttaaggatattgtaaaggttctgctcagagactaggacccccagaccaccacccccgactacagcctgggccatttcccagatacgcatcaggtggagcatctgctggtctttgttcatgttaccaataccaacggtaaccgtcaggtcggatctctctcgccagttggcagggttaatagcaacccacttgcctcgtagctggaagacctcttcctggttctggtacttaatggcatggtcatgcagaagttggaacaaacgtttaacaccagtctctgcgaacatccgtgcaatcaggtcaatctgttgctcagccgcagtcatcaactggttcacactcatagccgcttggttagagtgtagggtattttgatctagacctcgggtacggtcagtgatacctgtccgcttacccctgtctgcctcaagtcgatccagcataccataggcttccccagacaactgaggggtctctaggggcatgatagagttcatggccttaacccgaacgatacccgctgcctcattagtcagcaagtcttcgaggttaacctgaccatccaagactacagatcgaccttggttagtccggtagatgttgtccatgatgttgcgcatgagtaccgaacggatctcttgaatgtctcggatcttatcgtagacactcatcccatggaacttatgggcaattcgataggcattcagatcagcgaaaggacggcaatcccaaggctcgttgctgatgatatagtcgcctacatacagaatacggcgaagctcagagataccatccccatctacgtccagaagggtgtagcactcagaggcccatacctcacgattagcctcggcatcatccccagagttatactggagttgacccgtcatatcgaagttgtcacgtaccaacctttctggctgactatcagagaactcatactcgtcgtatggtagctcatcgagtacatcttcgggaacacccaggagccgcaggtcacttacggtatacttctcacggtgacataggaagcgtgcatcatcaatgcaggtagccaaccgatcaaccaggaagttctcaggcttgatgcaggtgactttaatctctcgcttcttcttatccttgcgaatcttaatgctgtaggttccatcctcgtccacactctgggctagaatctcagtgtctggatcagccaggatatccgctaccatttcctcagagagaccagagaaccgttcgaaggtggggttcaggacctcttccacgtagacctttacaaccccggtcttcatcatcagagtgtcttggaaccaatcgaacattaccttgaacccctcgttcttacgcatgaagaggtagttcacatattcagtctcttgctctgcctgttcaacatcctcggcagtctgaggttcatacttaaccacttgaccgcctgacgtgaataccttcataagagaaggcataatccagtctacagtctcttggacgtccctagatacaatcgcggacttcccagggcgctcattaccgaagggctcaccgaagtaatacttcagggcctcagagcgctgcttggagagttccgaagagttgaaatcaagggcgtcgttaacaagttggtctagatgacgaagtacctgttcatcatccataggcttaatcttgcgacgacgcttagccattagacaatactcccaaaccaatcaggggtcaactttgcagtatcactcctgtagtatccactgtttcgtacagcaccaggacgtgcataccgggaagccatcaacagggcataccgggtagcggagatcatatcgtcgtttctgtcgataatctttccgtcctttcggtggtacattttcatttcttttaggaagttcgtacacgtattaaacaccttcagatcaccattctccatacgggtcaacatccagttaacgccgaactctacagagttacctccgtgtttaccatcaggacccggtgggttactgaagggctcatacactacattgaggttgtggtcatctttaagaaggtctacgaatctacgaccagaggttgctccatcgtgcttaaaggcatcatggggaacaactaccgggatctggtgaccacccttcaggtagatagcatcagcgtgcatccccagggtttcgccagattcacttcgttcatcatataggtaatacttatccttctctgcatcccaggctacacaggcgatagcgttagggtggtcaaaccctaggtcgataccaatgatcctgtggaagtgatcggggatctggaaaggctcacatacaaacttctcttccagaatggggaagactacaccagatccgagcataggaacaccctcggccctcatccttcgttctgctggagagtataccgagagtagctgctctttaacttctggactgaggtgtggggcgtcttcccagcttgcatggacaaggaactgaccaggtttaagatcctggaggaagtccttcacgatctccgtgaggccatgctctggggtaaacgtcagatatacaatacccccagtagtagccgttcgggttacacactgggtataaatatctttggggcattcctcatcgagccagatgacgtcgatggcagtacccatgaatttgtcctgggacatttcgtaggacttgaagatgagggacgagaggcccccggaggtatgcttaacaactactgcttgcacacatccgggtttaccttccctacgaatcgtctctacgatatcttccttggggatcatccccgttccaaaagcctcagggttcttccagtcacctagtagttcggactgaagaatatcccgagtggtatccgtggagatccccgccgcccagcagttaactggacgatcatattttctaccagtccaccactcagggtatcgaccggttaggtggcaggccatgataaaggccccggtgtaggttttaccacagcggttaccagtcatagccagtagctgggcgcagttcgaggaagctgcgataaacttctcttgccacccataaggagtatactggttcatgcggaaatacttctgccgctccgccaactccctgactagattccgtagccgctcttgggtatccattagaccaccttgtcacctactgttgatgcacgccatagggctcgttggaagtcccttacgcgtactggagtttgtttggcccagaggctatcctctgcctcccatgcagcttcatcaaaccttccggatttcagaagattccacgtcttggggaacttcttcgtccacgctgtacccagctggaagttgacgctaactagggcatcgaatagctctggagtgcaaaaaggcagctgagatacttgcccttgggctgcatcataggctgccttactatcgttctctagccaagtctctgctcgggctagggtaatcggtccgtcttccccagggagttgcaagtgaccataacctccggtcattttcccaagggagtctttataccactttagtaccaacccctctcttcgcttgattagatcaaggtacttaagaggctgggaaagaaatgactttagccaactctggctcttcgtcgagaattcgtcgaacttcactgattagatcctctgcggacatatcttccacattcttagtagtaagctccagtttctgcttagctccgaagcctccacggtccaggatatcctgggctgccttgaggcgaatcccacctttctcttctgggttgctagcaatctctacaaccacacgaagcgccatggggacatgactcccgatgcgctcagagataaaggcgttgatgtattcggcatgctttcgatggtatgcagcaacgttgcgttgagcgtgattaggagagaacccagctgctatatacgcttgggttttattcataccatctgccagagcctcacaatagaggtctagcttttctttagcagaaagaggagcagccccaatcgagacaaccttttcgtctgacatacactgctccgatctctctaaatggtcaccccggtaggactcgaacctacgacctcctgtgtccaagacaggcactctaaccaactgagctacgaggagttaatggtggtcgaaggaaggaattgaacctctagccaatggcgtccgggttacagccggatggtagtagccatctacctctacaacgacctctgttggctgggacggcagggctcgaacctgcgacctgagagttaacagctccctgctctaccaactgagctacatcccaatgaaatcttaaggtaatttctcaaccttataatactattatatcacactttttctattttgtcaagtcttttttcttctttttttttattttagtcgcaaggcccggttttgttagggtttttgctggaatgggaaaggggttcttaagactatcttaagataaccttaaggtaactaaccttcttagtaagtaagtcaaaaggaagaaggaatcttaagagcctataggtctattatactacattttcgataccttgtcaagtactttttgatatttctttgataatcacatgatttacccgacgaacggtatgatagggttctatagatataccctaagactacccttcgtaggttgctggtaaggggtaagtggcatagggttcccttgatccaggttctataggtactccctgaggttgttccataggtatacccctagactacctctgttgtctatgtcctggcctattgcccctttatccagtaatataccaacaggtatcggggggtgcctttgatccagggcctataaccgggggataccccaaaagtctattttatcctccggtgtatctggggaatatccccccaggagtcccccagataaagtgggggtggcctatccccaggggtatagcccctagcccctccctaggataccatgagactaaccccaagatcaacccctagggataccgttcatcgggtggacccaagggtattcataagaaaaatcttagggtattcagtgggtggatcmckgggaataccgatgaatagccctttgatccccaattggcaaatccggggcctctaggttagctaaagtcggtctatttccgggggttggctggggagctt

SEQ ID NO: 14 - DNA, 88555 bp, Myoviridae Nankokuvirus
  misc_feature (1)..(88555)
ctctgtcaagaattctgtaacaatcactaggtcacgatgtgacccattgtgtaacagtcagcagactgtcatccgggcaggggcacttgcccccttcctgccctcctaaactagctggcttcgacgaagccttcccatgccaccagcccgactatgtaacagcctggccatgaccatggcccattgtgtaacggcattgcatgccaggatcaccagacggcctcagccagcccaattgtgtaaccattccccatctcagcagcagattatccccagccaggaagcccataaccctccccattgcatcccaggtgctaagccctaggaatacgtcgattgtgtaacccatggccacccatgccctagtaggcctcttcgaggcgagctaatgccggtggctctctaccctcacgggaagagttccccctttattatggcgaccgaatagagaatgtccgattcatgcggcctgtaggccattacaatggccagtccggggaggattgcattacacaataggcttaccctcacccctggattgacaggcctcgcagaggctagccaggctcagacaggcagcttgagttacacaattcaccctcacatattgccccactccccatgccacacccctgacattcaaccccacgcccctgcctcagcagatacatttgcttcgacgaagcctggatatttccatatcatgacggcgcctcatggccacccctgggtcgtgttaaacaccccggctgtagaaccggaatttgaaaacggatgcccctccccagtcacacccctcaggttgcccccagatatattccccaggctggtgcccaggaagggtacccccatgagcatttgaaattttggcgggggtgggtttctgaattgaaaaatgttgacaggcccctgccggggcttcacaatggccccatattcgctgctagagaggagacacccatggctttgtttatgtatgatgttgaccccagctccctgcctgtaggctgctacggggcttacctgaagactcccaaggacatctgtagtgccctgtgtgagctggctagctgggctaaggaaggatgtccccagcatcccgtgtttaaaagacaaaaacgaatctgcaacaacgtggggaagtaccttcttacccatggcaactacactcccctggcgatggtgaactggaagctggaatacctaatgtcctgggctgggttttccagagggcatcccttccccttcgagctgggtggtaagcgggatgagaagggagagtattacgagaaccccaacaggttgcgtttcctggacatggtgactatgatgtccaagatgtattacaacgatgagatgaagcgtttggaaggagggaagaatgatgtgtgagaatgtgcgttttgtactggctgtgaagctcctccgtccaaaggtgaaggaggggttggccaggatggtcaagtggtacaaggaagggatgcccgatgacttcaccttttccaagtacaccaggctctgtaccaacatccttcttgagacaagtgttgcgtatgccctggacgaagtgttctgggactatggcctgtcattcgtccactcgtacccgttcgaggaagggcagcggacagatgccccggaggccatctacgagaaccctctccgggtccagttcctgctggatgtcggtgctgtgttgaaggaggaaggatatgattgctgagctgacatatgctcaacgtgttgctgatttgaagtgggcctgggacaggactgataagggtctccaggaggtgctgagggagttcgtagcctggtacaaggccgggtgcaggaatagtgaccgattcacccgctactggcgtatctgcaccaacgtgaataaccactgggatagtggaccctatgatgacttcgaaatgggcaacctgttcatcgctgccgggtaccactacatcagcttcccgtttgagcaaggggagcgcctggatacctcggacaacatctacgataaccctcaccgcagggagttcctggaccttctccatgaggtgatccagcaggagacctagaatgaagctgtctaagcagttcgttgccaccctgatgggtgtgcccacgcccgtcaaagaggccctcttcgagcttggcaagtggaagcaggaggggtttcctggtgggcacaaggtgttcaagaagacttaccggctgtgcgataacctggtaggtttcctggagtatcggtctctggaccaatccctccttgcaccgtggtggtcctacacgtcagcgttgttcctggctgcggggttcccaggagggtcgtatcccttcgagaatggagaataccttgactgggcggatgagctgtacgataatccgaagcgtctgaaattcatcgacatgtgttgggaggttttgaatggaaacgtgtgattatgtgtggaaagagcttgcaccagaagtgaaagaggggctgttggccctggtgaagtggaaggatgggggcttctccgagcatccttgctttagccgaaactctcgtctgtgtaggaatttggcctctttcttggaggctaaaggtatgcaacggggagaggtgatggtactgacaatcgaatccatgtcaggtttattcctggctgaaggttttaaaggggcgtaccctttcgagaaggggaagggagaccttcagcccatgatctacactaacccccatcgtctcgaattcattgaaacttgcaggaggaaactggcatgaccctagacctaaatagagcacctgcttcggctacccactactccgttcggacggactctccctttacaaccttctggagaaaggaaggtgatctgtttacccgtatatgggtagctgatgcagagggtttgcgtctgccagaagggcgtactcccaccccttacgagaaaggtgttgcgagtgtttatgccaagcccttgccatccccgcctcaggatgtagtggataatcctgtcatagcttcctaccgagaagcgttcagccccgcccctcaggttgcgtcgggagaaccccgggcacgtgggaaagtgtactacagtagtctggacagctacgtctggagccaggctccacttcaggccaacttcttctccctggggctgaatggagagttgagctgctggctgcacatcgaagaaggcaagatcgtaacggtttggacggagcagggtacggtgtataactatcggacctcagaccgccaaccttcggtacctggtccgagattcccccgcccccagaagaaggaagaggcctcccctcaagagtgggacggcgaaggactccctcctgtcggctgcacagtccaactggtggacatctcttctcctgtgagcccacctttcgatgagtggctgcttggggactacctggaggtgatcgcccacaaggaggtttgtggaaccgttcgtcctgtcgtgtggaatgacaggaagcagacgggatcgtccatccttccaaggctgattagccctgtgtcccaagagactctggctgccgagaaggaacgccagcaaggtatccaggaaatggtctctttggtgagcagcatggaccttgcccgtgccctggaagtgctgtatgatgcaggctatcgtaaacaggaggacaccgaatgaacacccatgaacgactgctacgtgctgtgcaagctctgcctcgggaattgatcccgtccctgcatgacctggtggcctggtaccactcaggctgcccggatgggtccccgtttaacacctcccgcaggatatgcgggaacgtataccaacacctcatttgtgaaagaggggttagtcctgaaagggcctgtgatctggaggactgtctgtactctctttacgaggccttcctggatgttgacctcagcgacgaggggtacccattcgacgacgaagcgacaatctacaagaaccactacgacaacccgctccgcatggccttcctcaagtgtctgtcggaggtgatgtgatgcgactcaggaagattgaacagataaacttcgagaagttctcctggcagactcaggttgccttgaaggagctggctcgttgggtgtttaaggatatgggcccgtggactgagggtaagacccatccagccttctaccggggttatcgtatctgcaccaacctacggttgtgggagttgcattacgggtggggggataagcatggtcggacgatccagacggagttatctgaagagttcgttcgtgttggtctggacagggaactccccttcgaaggccgtctctcggatgacgggatattcgttctggacgaagatgctgtcgaagaactgtacgacaacccccttcgtcagcggttcctccggctggtcctggagaagctttcaggtcctaaggtggaagtcagtgagatgatggaagacgcgctcacagccgtggcccgctgggccattttgaaggagtccttcccctgcttcgaacctcggttccgaatctgctggaacgtggagaactacctttcctggttagggaagagcgaggcagaggtcgccaaagcttatcaggagttgtccaaagtcttcggcgtcatgtaccccttcgaaagtgaggaagggtttgacacagagggagagatttggaagaatgatcgccgactctctttcctggctcaatttatctgaggaggtgatatgcgtgatgtgacgtgctttactcaaaaggaagcccacctgtatggtggggtactaggcatgcaagacctccaattgcacctccaaggtcaagggatgagcgctgaagaggcatccgctaaggttcgattcctcgtctccagctctggtgtgtccttgcaccactccacggttcgagagattgcaggctactgctggagtgcggggttcactttcgtggacatccttcctcttctccggtctcacgggttcagccccgcccagtgttgggatgaatttcgtcgggtgtggtggtggtgggaaaaaagctaccgccaggatatggagagccgttttaagcttatggaaggcagcttgaagcatgagtgacatttaccaggtttacaaaacgattggcaaaaactgtgccagtaacgaatcgccggccctgctgtaccctacggacgttatatgtgggtggcggcaggccggaggactctggttttctgactgtggcctggaatggggtttcattgaagacggtcctcaagaaaatggaatgaactactgcccgaagtgcggtaagacgctactctcaaaaggaggggaatgagaatgcagacaattaaactgagcgacgccatagtgcagggtatgggcaaggcgctttctacaggaaagctcagcgctatgtgtttccatttgatggaactcctaccccacgaacaccctgtccaggaggaattacactgctggctggagacttatctacagacgaaaggccgtgattactcctttgttcggaccatgcttgaagttcatttcgaggagcttaacccaggcaccctccttacccgacaagaccttggccatctgtggtgcaacttctatgtgtgggccgtcttcgacatgaagcgaaaaggtatttgacttaaaattacatccctgtgaggagcagatgagcgaacgacttcggagactggaagctgagtattcacgtgttgagcgtgaatggggtggcctagccaggtatgagctggagatgctcaggatacaaatcgattctgaaagaagaatcagtgagcgtaactcgtatctgtcaatctttggatgtgggaacgcattccacggaaggaagtacgactagcttagcaggccagacgttaacgtgtgctggagggttgacactaggtagcccctccggtaccttgtcttttcttgaattttaaccgaggagattttaatgaaaacttatgaagcttctgtgctgttcgatgccagtctggcaggctctttatctgttgaggccaacagtgttcaagaggccatcaacctgctagaagacaaggcgggttaccactccccaaccttgtgctaccagtgtgccggccacctggaccttggggacatgacgggtatggtggtatactgcgaggaagaagaggtagcagacaccacctacgtcggggaggtcatacgcacgctgaacaagaaggtgaaagctctggaagaggacctcagcaaggcatacaagctgctgagtgaaatccgtcccagaatccctcaggatgtcctgaagctgtggtgtgaagatcgagataccattctctctggcctgaggagtgttgaatgatggaaaaccgtaatgggatcgttgaagcagcttgcccgaagtgtggaggctctggtcacgcggattctggaggtgttcaaccttggggtgagcctatctccatcccctgtgattgcctaactgagcaggaagagttcctggcatgggccaatgaggagtacgaggttgaagagggctacgagttgaacgaaagcaaccccgccgtaatggaaaacaagaaaggctggatggcccgtgccgacctgccgaagcgttctaaattccgccaacacctggatgagcgcgacttacagggcgcacagggggagcgggagtgcggccataccgcatgcaaatcactcggcgagcatcacccgttctgcaagttcgtgagcgatcaagaccgcgccgccctgtcgcagccctctccgctgatcgtcccggcgccggaactggacttttcaaggccgctggaaactgcgaacggcgagcctgtgaaatggataggagcagatgtcatcgagtacaagagtgctctcgtatgcgtcgctaaaaacacgggaattgtctatagttctccttacatcgggctgaagattcgcaatgtgaggccagaacaggtggacggggatcgaccagatgtggtggcctatcaagcggcggatgccgaaggcgggacgtgtttatcactccgggaagacttcttcggatacaccgtaaccggtaaggaacccctgatgaccattgcccagcatgagcgcatcgtcgaggctctccggttcgaacgccagcagatggaccgcgctttcactgcgtgcatcaacgagcgcgccgccgccctagccaagctggcggagcttgagaagaagttggacgaatctgaaaagcgcggcgcagaactggccgctagctattgtgacggtgtagtcggcgatgaatacggcaactcttattgccgttataaaatggaacacgacgccgccctggccagggtcgctgagctggagaagccagaccctgactacacccagcacccgcagatcgtaggctacgcccgtaagaaagagttggagcctttgttggacccgtgtcaacctgatggcggccacatttacataggtttggaccatccggcgctctgggcagaggaaccgccgtatgaattccttactccgctctacacagcccctgtagcccaggatcagcaactccacgacctggacaaacagtgtcgcgatgacgtagcgcgtgcgctcggcttgcacccgtctcaggagcgcggtttcgcatggtcctacctactggcctcgatcaagtcatgccggaaggcgtccgaggatgccgcccaggctcagcacagcgtgccggaggagttcagcttcgagtatcgccaccccaatggcgagtgccacacggtaacggtaagccgggagcaggtgatcaatgagatgcccgacttcctgttcgaagcgctgtgcagcaagttctgcaactgcgagccggtgggcgagacgaacgttgtcgagtgttgctgcgacgagtacgcggaggaattcaaactaatcgacgccgcgcccggcaaggaggtggtgtgatgggaatctggatggaagtgaggtgtgaggaccgatccgaggagtggtccgagggtcacggctatttcccgcacaggtgttggtctcacgaaaatgaaggaccaatgggagaagctcctgaaacaagggaaggagtgattaacacgtacagacacctggaggaggaagcccggtccctggggtgggtaaggttccgtcacgggtgggtctgcccctattgcaagaacctcaggcctaaggtatagttggcttatctgtcggaccctcaacccgtaaggaggattaagaatgaacattgattggagtaaggcacctaagggtgcaacgcactgggaaccaacaagccagaaatttgtcggaggatggatgaagaaagagggttcctcctggttttggtggcgcaaccagactcagacttggaatccctcttatctcggtgacccgtctcggctggcaacattccagcccctaccgcagaagacttgggacggccagggcctgcctcccgttgggacggtttgcgaggcaatccacgaagacatcaactcaggcaagccggtaaaggccgagatactgaagcaccacgacaacggtctgtcggtcgcgttcttctgggtcgacgcacctgtcgaagccgaaggaaatctgtactgggcccaacgtttccgccctctgcgcacgcccgagcagattgccgacgaacagcgtcgtaaggacattatcgagttggctaacgtcatccgtgatgctggtgatggaaatgattacatgctggcagaggccctgcatgacgcaggctatcgtaagaaggagtctgatgatgactgacatgagagaacagtttgaaaaccgattcccgattcctgaaggaattgagtggcgtaataccgattacttccccatgaagaccgataacgtcagcgtgtacgtgattcttgctggagtcgctgcgcgctacacgtcgatgtggcaagcctggcaagccagccgagaggctctaaaggtacagttgccggacgacgggatcgaggactgccagcgagactggcagaactcctgccgagataacttcgacacaggttactgctatgcaactgaccggatcattcaagccctccagcaagccggaatcgaggtggaacatggctaatcaatacctcagacccgaacagatggtagagcctggctactactggtggttgccagaatatctgagcactagcccagagaaggaagagaactggcagataatctgttggcatcctttagacacgtccagggagcgtgtcggggtattcgtcggacctttgactccacctacggagaccaagttatgaccgatcacgcaaagctgcggaggctggctcaggcggcaacgcctggggagtggcatgccgtgtgggaggaaggggatgacgcagcatgggcgaacctcttcccgatcattcaggcagagtgcggagaggtagtgatcggaaacgaaggtttctactccgacctggaccaggataaagctaacgctcaattctgcgcagcagccaaccccaagaccctcctcgccctcctggacgagattggaagactcagggatgaagtcttggccctgcgcgaaagggttggggttgctccggcccgtctcacgaacggcgacagtatcggcaacatgttgcgagagattggttacgccggtgaagtcagttaccatcatgcacgagaaatttggaactcctgtatcgacgagcaggagcgcctcagcagcctcatggtgagcgagcaagagggaggtaatgatgtcagcaatcatcagtgagtgcggtaaatatcggtaccgcctggatcgagactgttcgccaccctttgagggtagcaaggtgtacgcctacttcggtgttaaccccagcacggcggatgccagtacagacgatgctaccgtccgaaagtggagaggcttcaccgagagaaatggaggccataggttcattgtggggaacgtcttctgctatcgggccaccgacgtgaaagagctgcgaaaagtggacgacccgtttggacctaaaagcgtggattacttccagtccatcctggccgaagctgacatcctggtgccgtgctgggggagcctgtcaaagctgcccaagcaccttcgtgggtgccctcctcaacttcttcagtggatgctccgctctggtaagcccgtcatgtgcttcgggctcacccagtgtgaccaaccaaagcacccccttatgctgggatacgacactcctttgcaggagcttgtagggagctggtgactcttttcacctctacttaaagccccgggccttgacaagtctggggctttgtcgtatctttctttcaacaaacaggaggtggtatgaacggttctagaaaatttcacagccccgatggtccagctttcttcccgggtgaaatatgggtaagttgcgaagggtttgaggttgagattttgaaggttgagcggtacggtaccgacaagtgggatgttgacgtttactacatccagtgtcggtggaaaaatgcagatgatgctgtatttgtgaaggatgcttggaatttccaagtaagatatgaacatcaagcagataggagggtacatgaaaaaattctctgagacttactactcttggtcgggggctgccagccgggcaaaagttcttactgacctgggttggattatctctattcacagggagaaggttgaaggttctaccagtcttgtttggaaattggaggcaacgcgatgagtgagaaaggaatgatcctggcaaagtacactggccttctgtgtggggttaaagtcctccaacgtcaaggagataaggttcgggtaaaggtggtcgatgagaagcgtcccaaatgggttgacttggcttctggctcctacaagctattcaacaatactgatgaagcaatccaatggattgaatccgaggaggtgaccaatgaaacaaactgaaactgctatccgaaacatccaaagaatcttcccgttcatggacgatactcgggcagatttggtcgcggacgttttagtcatggtagggggctatttccccaaccttcggaaatgcagtccacttcttctcaaccagatcgtagttcatcacccagaccttaaccgacaggaaagtcgaatgctgaactcccgaagaaaaacgtatcatcacctggccacactttccaaccagttaacccgtagtgttcacccctcccaggcaaaacgtctacaccgcatagcctctatgctagcgaagtaacctccaaaggcagctatttagctgccttttttattgccctttttcagcctcctttgatcctctatctcactcactccgtacagtctgtagccccgctgcaagcgctttgagaagacttctattgaacctgtacacatccacgcctctcctccttcgtacattatgtaagcttcgtatttcaaacccctgccctccatctttctttcctgcaaaagaaaaccccgccaactttcgccagcggggtttcattcattaggcatcctgcctggtgttatcccttactccctttgggaagatactcctcaggcatggtccagtcatctttcaacagggaaaccgtgagaggaacgcagcattcctgccggaaacagctagtctcacacctgtgatgacagcggcctccatccaggcagcgggttcccaagatttcgtcttctcctgctaaaatgccgcattcagccttcaaaacggaagctcccacttgatgagtctttccagggctacctcgatgtccttcgctctcagggggtcttcgtgcccctcgacggggaatgttgcctctaccttcacatcgtcgattaggcaagctccagggacctttcgtactaccgttgggaccacgatggagacgatttcacacgcgggagcgtaactgtacacctcgaattccgctgaggccccttcatactcattcccttcgggagtccaacgactccacacgtaattgacgacaattctcattcgttccacctcgtctcaccctgggcttttctttctagcatctgcttctcctgagcttcctggaaccgggcctcatcccaggaagacttaccgtcaaccaggattgacgccagaatacccaggattgccaggactatcatcgcttctgtcaggggtgaaccctttttcctttttcattcggtctccttggcttgggtgaggagtacattggcttgtcgctccatctcggcgatgtggagacgctggaagccattctgagtttccatgggagagaggagtacctggtttgccgggtaaccttcctccggagtttcttgggtgtccggctggggcaggtagcggcgacggtcaagctcttcaaacaggataaccatatccttgtccatctcacgagtgcaggtgatcaccccgttgattttccagcccacgccgccgccatggatggaggttacgctgacggtgaaaggatcgtgtttgttgctcatttgggtctcctgaatgtgaattgaaagaacatcttgttgaagagcgtctagataggttcggacctctttgtttcggttggccttactgtccaggtggctcaggtgtaagtagcttgcagggcccagccgtgcagctctgtccgaaaccaggttgaacagcttgagggtgtctcgcttgagatttcccgacagaacgatccaggaaggctcaaactgggggccgtctgcatgatctgtgtacaggtctacggtcagagtgctcatatcataccccgttgttaaccaaggacgttaccagttcggtacggagctggatggtgcttggatgcccttgaagggtccagtcatcgtactggcccgccttctctttcaagaagctgtacatggcatccttgaggtaattcttgtcgccagtaaattgccgctggcaaaacacttgcatacctttaaccgtgtcttgttccaggatgagggtaatcggtcggtttttcatagtatctctcctctttcacgggcttcatcctcgacatcatctgtcaaggctttctggaactccatggtacacaggtagaccatttcattcaagattctcttgttgagtttctttctccggttctcatgctctactacctgagaagcttttggacgtttcggaagcttgcctaccaggcagtcgtactcctccacggtcagcaccctgcttgcctggatacatccaaaaccctctccaagttcggtcataacttccaaataggagacgtaagctagaccatgaaaaccctcttccaggctgtttagcttcaactccataacagctaatcccataatttgtacgccctcactgtgccgcccgagtaaatatccagtgcctttgctgcctcaacagcctcctcggcactggcccctgccatcatggctcccatggcaaactgtgtgcctgatcccgcagcccttggcctgtccaggttcaccttctcggtgtagatgcctccgtcccaggagatgaagtgcagcccgtccgcatcaaggactagaccggagaccttcagctcctggtcctccattacatccccgtttacataggcctcggcgagaatcttccagtcgaatactgcccctgacagccagaaaacacagcctcctacctcgatacgtttttcagcgtcctcgttggtgatgatactgttctgagtgatccttccatccgttgctacgatcccatccttgtaagcgatggtggtcatgcccgtcctaccttcttcaggtacaggcggatcagcggatagctgatagggagcagtccaacaaggatgaccacccgggcagtccaccaagccagaagaacagcagcatcccaaacttcagcgccgaggaatgccaagtcctcacggttgaagggagtttggaaatgaagcttcagttgttccattttggacatctttttcatgattcctcctatgggcagcagcggggagagcccccgcagtagaattcaccatccttgcagtgtccgaagtagtttggataccctgactttccgcagtcccccgcacagtctacttcttctaccattccgttttgtatttcattttcccacaacacctctcggaggtgtaagggaaccttttgccagtcaaaccccattatagctcaccgagtgggctgaggacaggtcccagacaaggcaatctttcaggaccgatcccatccgttcggagccctccaacggaagcagcgcagtcatcgcagtaccgtcggagtaggaatctttgacatgaccgaaacctcccttgaataggtatgtgcggtaaatcaggtcatcagcaaacccctccaatcctttcaagtacagcacgacactgatccctcgctctaggttcgagattgcctcctcgaaattcacctgcttcattcttcctccttcgcttcaagccacatggcacgggtttccaccatgatattgtccagggttgtattcccgtataggtgcttcttgcagcgggtggcggcaacgtacaggagattctgctccatctcgttcaaacctacccaccgcttcttgtcatcgtacccactcggatagtcgtcagccaggacaaccacatcaaactcccgacctttggacttgtgtgcagtcgtcagtacgatgtctgccgagggatcattctcatggtcacggagggccttgaaaatcttccactggtcatccccttcgatgatccggcacaccctgcccagttcgcccgggctctctgcgtattcgtcccggaactcttgccaagaagtgtagcacaggatgttttcgtgcttcaccttcttctcgtcaccctggtacagggcggtagcactctccagcagacggataaagtctcgggtgtcaatctccagtcggacactcttaccctgaccaatcaggtttacagcgtcccacaccaaggcggcgttggtccgatagagccgggcatgctgctccgggatttcaggtaccccttcagcgtcaccgtccgccaggaagccgttgctctcccataccttcgattccagcttttcccacccgtgcagggcttgggctttgctgttctgtaggatgatgttcgccacttcagccactttctcaccgaaacggaagctggtggtgagcttgcactctggggccttaatcttggccatagcgttcacgctgccacggaagctgtaaatctgctgccgagggtcgccgaccatgaccagcagggagtcctgctgacgcagcacgatgtccaggacgcaatcgttggtgtcttgggcctcgtccagatagatcaccttgtactggctgaggtccggcttggagagctggtacagcttcaggtaggtgtcgtggttgatcagcgtctgctcgttcgggtcaatacgcttcttccacaaggcctttgcatagcggagaaccagggcctcatagtagggaaggtctacacggtccttctcggaaagctttgccaggggcatgtagctgatgtgcttgacctcaagctcctcgtctgccgaatactcgaatcggttcaccgtatcgcggatcgcctggccaatgctggaagccgtgacggtgacccccatgtccgattccatgctggcgatcttgaagtagcgggcaatctctgccccggtccccaggacgttgacgtagccccctttagggcggcgaagtttctcactgagcttggccccgaacaccccgtatgccaggccgtgggtcgtcttctttaccacccactgcgggaacttgttcttggcctcttctgccatggacttgttgaaggccaggtacagggaggtaacctggaggcgttgagagaccaggctcatggtggtggtcttcgctgcgccggcacccgcattgattttcaggcggcgattcggacgttgctctgctgccagttcttcggcagcctccatgatgtcccactgctcactggtcggggtgaaactcataaaaattctccttaaattcacaaagcttggggtatgccaacaaggccgccttcatgtaccgactggcttgcctgtcgtcgatgaggagcagtttacggacttcctctgtggaaatcaaggggaggaaggtaaatattttacgcagagccgatttcgacagaggcacctgtctgtagttgcctgtcgtcccgctcacaccctccttacccccggcgctggaccggtaccaatccaggttggcaaccccgtggaagatgttgtccatctccaacggccagggatcatccctctcaaacgcgatgaacgagaacaagggcatcagttggttttccaactggcgccccttcttgttccccttgcgttctttgtcagccctgagccgattagcccgcttaatcagctcatttgcccgggcttctattcgggaatagtcccgtatcggtcctccattctcttgatccactctgttgcccaacctctcgattcctcgttgtgaaggttcgtcacccgaacgccgtgcgccttagccagcttgacggctgtgtttgtgcctccctggacgctcccgtccttgttcgggatagcgaagcatattaggaattcactgggagtctccagatcatcccccagcacctggaagacattcctagtgtggagcttctttgcccccgggctgaggtgttcccaggcaggatggaactgctgggcaatctgctgggctctgactcccagatcgtaggggatatgagacagggagactacagcaccaaaggcatctccatggtgaagcctgtcatagaagccattccacggtatgtagattcggccattggaagtaccatcttcatcccatatctgatgcttccaccacccctcttcaaaggcttggtctgcccctggggctccgcctgtacggagggtaatcccagcggcggataggtagtaccccagcttgaccatgatgtcaagaatatacccaggagtctcccgtgaccctacacctgtgtagaacagactcatgtggttacctcgaaccctttagattccaggaaggacgtgatgtcgtatacctccatctcctccaggatatctcggggatagatattagagatgacataatccaagatttcatcatcgtccagttgagccagaattgcatcgcacgtagactttacggctgtgagttctacaaccacttcagggccagaataggggttgtacgcggcttcaacctcaaccttcttagcctcaattaccaggtccatacttactccttatgatttgtagtacacgtgacgctcgattctgagcgtctttttcatggttttcgtccagcggggcatgtatttgacctttgaggggttcaggtagtgatccgcccctcccgtggggtctttggacagcccttttaaagccctccaggccaccaccttggactggtcccactggtccttctcttggattcctgccttccggcttccatcacaagtgtacgagaactggcaacggaagtacaccactccgggaaccgtagaaggccagcggtcggggttgttcatcctgttgagaatgacgtgtgcaactccttctttgcctctccagctttcgcctcgggcctcaaagtagatagcctctgccagggttctgcaagacttctgacgctcgcacaatactttataggtctctcttttctggacttcatgcaggggctgactgctgagaaccgcccgcttctctaagaggtggaagcgagaggtctcaaggcctaccatgacctcgaacagtagtccggacgcggccaatagagtgctcaggcagagcgcttctagggtcttcattcgggctcctttctgtcaggctagtggtacatgccggcattgcgccggcacggattacaggaacgaagccagcccgttccggaacacagggaaggcggtgctcaggaattcctggctgaagtcttcttggcagaacttcacttcatgcttgtagcagaagactacgaagtttgcttgcttgctcttccgggttctcgtcaggaacactcgttggacgatcttcgtagcctggctcaactggaagccgtaaggggtcagctccagaccttgcagtttgggcttagcaggtgccagggtgcctcgaccagtttgcagccacaagctcttcggctcgttgtgaagatcgactgcggtctggaaagacagtgtttgtaggcccttgctcttcagctcgggaatgctggtatagaagctgcccgactctgccaggaagccatagcccaggctgcccatgaaacggatcaggctgtccatttgaagccatgcagtgttcttggcggtcgccgagtcgaaagttgtacgatgggtgaatcgcaacagcattttcatagtaaactccttctgtgaactggaggccagtatgcctggcctccttggggttgtcaacctcagtctacgggatttccgttttcgtccatttcacgccagcacaggccgactgggaactgtggaaccagggtcttcttgaaacggccttggtatttcaccttcaggtaacgcccgatgtacttctccggattggccagttgatcccggcgagccgcatggtctccgaaggttgtatcgaaaattcccgtggcgtattgtccacgaccgtctgctttctccttcactttggggcagaagacgcggagaactgcgttcccgtctttgccttccaccacgtcaacaacctcaaactcctcgtccaggaatttcttgtacttctggaggtcggaagatcgctgggatgcttcgtaaagccccgtcatgttcctaagcatgatgccttcgtacccttccatgacaaccttgtcgtggtacttgtctacgtcctcccggaagaagattacgtcctgatccactacaaacagggtgtcgtctcccaggaatgctgtgttgttgattcgacgaagagcatccagtcgccaagagaactgggtatcagcggtaacaccgaacgcttcgcagttcactacatcgaaaatgtggtattgcaatgccggacgcagagcggcgatctggattgccaggtccaaagcgtcctgggcttcctggagttcagagtcatcagaaaactcgtcgtccgcgtacttcataagcttcttctcagctttctccacctctttgaggggatcagtacgcttaactgccgactggatgtcttccagggactccccgtgcaggtaaatctcaccatcaaaaatgtcgccaatcttcatggtctgggccagagcctcggcgacgtggggcaggatgtactgctccccgccccggctacgaagctccacgctcccatcttcgtgtcgaagggccaggcatcggacaccatccatctttgggctgtagatggcagggaaggtgatggacttggcccgcttcaggtagtcctcggccagcatcgggaggatcggaacattgtccagatcactcttatcttctcggtaacctgccttgaattgcttctcaaccttggaagtggcttccagatgagcctgctgctcgccagtggtctcgtttgcacggcctacgttcttcggcttggaggtggtcaccttgacagttagcttgccaccctcttttccgtgctccacgaataccttgtcaccttcgctccagcagctccactgcttgaagttaccgcccttatccttttggtacatcgtcactttttgcataaaccctccttattaacgaaattcaccgtctgagctttttaccagaatggcaaactcatccaccttgccgagcgcttgtactccaaactgctcttcatacgggttgcttccatgttggtcagcaacatgcacagtagtcagatacagctcatccatgaaggctcccaggggagttgttgccgccactgcggataccttgcctacaagagctgcaagcatctttgtctcttcgtaagatagctcaagcaacacccgttcgcgtttcttacagtcttgtgcgtacatgtttaatctccttttggcatgtggatgacttcaaccccgttcttcagcaggtaatcaatgcctgccgtcaatcggtactggtggcgatagtacaccctcttgatgcctgcgtcaacaatgtcgtgagcgcaatattcacacggggacatggtggcgaacatccaggcaccctgagcactctcctggctgcatgagagccacagtagagcgtttttctcggcgtgccgtacctcgggcctggtaaccccctcctcgttctccagagggccttcgaggccgcctggtaggccattatacccctgactgatgattttgtttccctggacaatgactgcaccaacttttgccctaacacctacagagcactcagcgaaggactcggcgcagcgcatgaaagcctctttatgcttctgcttcacagggagtacccctgtcttttctctgggtattccaacacataccggtttttaacctgtacaccgttgatggcgttgtacgagtcgatgcacatgtccagaaccagctcagcaaaggattttgacaggtccatccctgtcaggtcttcgatatttgggcaccgacttttaagtgcgactgctccttcgtaaatctcctgctgagcaatgatagctttttctaggtgtccctcgggaatatgtacgtctgggtcggtagggtccataacccacacctcagcctttctcacggtgtttggccagataaggtggcagtcccgccatttgttcggatgccaggagcataggcgatccagaaggggctgatacatcttgacctttgggcggtaaaccgtcagaccgttgttcagtttctctaccacaatcattgtcttcatagcacctcctaggatggcttgcgttggccttttctggttgctgtcccccggcaggtgaggtctcctttggcctgctgcatcttgctggccttcaccgtgtaccgacccttgccgtactcttcatctacgaacgtctgggccttcattctgtctcgggtgtgtacgaatacataatcacccatagcgttctggatgtaccaggtggcaggcggagcgaagtccaaagccgagaagtcctggaaggtcaccacggtagttcttggggtactgctcatgtttactccttgcggtattacttttgcaggggcatcctaacccaatgcacctgcaatgtcaacttatttcaggcgcaaaaaagcccgccacaccgggcgggcttgattgatcagctttccactgcttcttcagcaggctcagaaggagcatcttgcttaggacgcttctcttccggaaccacaacgctgtacagagcctggagcatcagacctacctggtcctgtagttcggcttgcaccacggcgtagcggccattcacttccatgtagtccttggaacgcaggaaggagtccaccttgcggattttcttccagtcggtaccgtctgccgtcatcactcggtcgaactctttggccaggggttcgaggttgaccaccttcacagcctggtacagtcgatccagagtatcttcgtccggcataatcggcacgagaacactcatgagggcgtcatgtgccatttgcttgaacaggtcctggcggttcagttgagttgctttctcagtcattcattctctcctttttcaatttgttcttgctcagcttcatcctgctgcttaggcttcggctttggctgccgctttttacgggccggtttctcagtagcctgggactcggcttcaggttgtgactcagcttcgggctcggaagaaccgaagtcgaacacgacgttctcatcttgccccttctccaggacagcccagtgcaggctgctggacagcatggacactcgggaggtgtccagggtatatcctgccagaacctgggattggaatgcaagcaggaaattcatgaggttgtagtctttgacctcaacggcgttctcagagagactcttaacggcctccgggctggcgacttcagtaggaccacacacttcctcgtggaagagggttatggtacgaacacccgaagcagagctgactacggggaatccagccatggtgttctcaacacggtagccttcagcgatggcatcttccacggcttgcaggaagctgatggggttttgttcgactacacggatacgcttacgatccgctggataagcaggttttacggacatttttgattcctccttgggattgagagtacactataccaccatctgaagcagaagtcaaggcttgacaagctaaagaatttatagtaatattattaaatatattatatataatatacaagggagggagtgggcaagtgcccctcccttgtactaagtatataattaatattaattactataggttaatttttatgagatgtaaaggctgtaataggataattaagtatcctagtaagaattcagtatcaggtaagcatgaagacctctgctccctgtgtcaaggccgtgccaagatggtaggccctactgagaactacgcattccctcatgcgaagcagggcttgacaccagtccgtcaatgtgactagggattgacaaacacacctacaggatgctatagtatctatagatacaccagtttaagacctgggagggttcctcctccttcccctctcaggcacccaaccaaggagtaagtatgagcaagttcgtaaagggccagagtggcaaccctcgtggtcggcccaccaaggaagctcaggccctcaaggcgatgtctgccggagagcttgatcacatcctcaaaaagctgaagcctgccagtgccaaggctattcagctcatgatcgacgaaatgaccaatgcgtcccagacatctccagtacgtctcaagatggctgacaaggtgttcgctgcctacctggcagccctcagggcacaggcgtccattgacgcagtaaagaacaagtctgacggtgttcctgagcaggaggatgaacctcaggcccaggtcgtagaattctcgctcactatgcctgccaagagaggagcatagcatgcaagtcccagtagaagtaatggaccgggtgttcccggagtcaagggtgtatgtggaatcagttctgacggactgccaaaccctggaagacctggtgaatcacaggatcagcctaagccgtaagatgggcctcaaggttccaggctctccggagtaccgagagctttggctggctgagcaaagtatccatgagattgagggctatgtcctcggctcttgtggtgtaggggcctcccagccccactaggcgttcccggagccgtatggcgggaggggttgaaggttcaccacacgaaccccctacgccccggaggttgccggggtaggtcctccaggctctaaagtcctggagaagtgtcagccggacctttgaggatgggagtccaccggcaatcttgacacggcgtactgaacacggtttaataccctccacgaagaaacaggaggtaccatgagaaacatgttcgttacgccccatgccaggaaacgctttcgtgagcggttccggctccagttccacccctcggtcttcgaggacggtagagacatctacgtcatccggaagcttttcgctgaagcgaaatactgtgattttgagcttcgtatgcggataggaaactataacgcgctctgcgtaaagcacggcagggtcgtaagggtttccaaggttcggaatttcgtattcgttcacgatgactcgacgatctacacaatcctgaaggaagggatggttctgtcaaacgtgaggttttagggtaggggtcttggcgaccaggttggactccaaattcaacccagctcagttcgaatctgagactgcccgccaaaaatctcttgactttatctgaaaatgtggtaaagtggatttaagagactcagatgtgggaccgacgaagctgatgtgcagaggaggtgatccagcatctcccggacgggtccgggttaccaacccgctaatttcatagcccgacagcaagggtagttcctgcggggccagggtccaagtgaccctcctacattccgttcggtccctcaaggtgagggagcttgactgttaatcaagacgtgcctggttcgattccagggagcggagccaaaagagtaacctccacgcataaggcctggcactgcgcaccaggaggttagtttcaacggaggggtggcagagcggtttaatgcaccggactgtaaatccggcgtccgactgggcatcgctggttcaaatccagccccctccaccaaatgctgtgtaagttggactgttgcagtgaagcgataggctccccggatcgtaagccggtaacgtggggatatagggctcccaccgctgagcaacaggaggttcgattcctcaacacagccccaaaactgctccaggcagttcagctaggctaggcttgagaggtagtagcccgtttttccaaaacctctcacttacaatcaggcgtgtggcgaaaaggtttaacgcactggactttgactccagcattcgtgggttcgaatcccaccacgcttgccaatctacccaatgctaattgggtcttgtcgctccgggtcagcgactcagaagtgacccttagccccggcgatcttcgctggggctttttactttctcaacccgtaatggaggttgcaaatgacgttccaacccactcacgcacaagcaagcgtgatgtctgacgataagcacagtatcatcatatacgcctcccacgcaggcggaggtaagtcccacctcgtagctaagtggctcaccgaacccatgcacgtggaaggatatcgaggcttggcagcccggagaaccattccatacctcacaggccatggaggcctggcgcaacagatagtggatgttgacccaactctgcgtttctttcgaagagatttgatggtaaggactccagatcgcaggtcctccatagtttttcgaggcatctcaaacgaggaagcccctagaagcctgggaggattcgtatttcaaagggcagcggttgacgaagccaaccaggtagacagcagcgctctgacgtacctattgagcagactcaggaactcccaatgtcctgagataactcctcaggttttgatgacattctctcacggagactattccagcacattcctagacgcccttgtgcgacccttcattgaaaaaggggacagcccacgaggacacggcggggtagggaggattgatcccaagaagagtggtcagacaaggtggctcacctttttacgagggttgccggttgtcgcaaagaaccaggagtctctgatagacctcttggaatgccacacagggcaagcgccagaagaagccaacctcatcccgtacaccctgtacttccagccggacgttcacccggttgtgaaagaactctaccccgagtacgaatctcatctgaaaaccctcgcatcacctttaagtgttcagatgactggctactgggggtgacgaatagccccgctatgcggggcttttttgtgcccagggattggccccgggcaatgcaacaaggagcctaccatggcttatgaaatgaccccagaggataaggtcctctacgatgcaatcgctcgaatcggcgtcctgggagctatccaggcaggtctgatgaaggcagggggcggtggggagcctgcaccggcaccgaccgtagataccctggaaggcgctggagccactggcaaggaagtgatgaaagctgcggatgctgctactgcacgaactgctattggagcaggaacctcgaacctggccatcggtaccagtgcaagcactgctaaagcaggcaactggaaacctgcctgggcggatgtcaccggaggcgacgcagccgtttctgcgggtgttaaggctaaggtgaattccgtcgcagcagtggccgaagacgccgagttggcagccgtcactgccaagcttaacgaactgttagctgccctaaaggcataaacagggactgggggcttgacaaagttaagcccctagcatatactgaccatataagcaagagaaactttgagggcttgacaaatgactaagacagtcatcggtcctaagtctccgaagcaggaagcgtttatcaactccactgcgaacatcaccgtgttcggtggagctgccggggctggtaaatcctacctcggagtgatggactttctaaagcatgtgaagtacccgatgttccggggcctgatcactcgacggaccactcctcagattaagggccctggcggtatcttggataactgccttcagttgtacaagcagtttgacaagaatgtcaaatggaaggataaggacgggaaattcgtcttctcctcgggagctgagattcaccttcgacactttgcccacatcgacgataaggacaactaccagggtctggaaatcaacgaatttctcgttgacgaaggacagcaatacaccctggaaatgttgctttacttgatgtctcgtatgcggggtccgaagtgtccagaggttgaacctcacatgaagatcacctgcaaccccgattataacagtccgctgcgtaagtggctgacttggtacctggaccctgagacaggtatcccgctcccagaaagggacggaatcactcggttcttcactatccaaaacggagacatggagttcgctgacacagcggaagagctgattgaaaagtacaatctgaagtctcctcccctgactttcaagttcatttcggcaaacgtctacgacaaccctgtcgtgatggagatcaacccccagtacgttgcctggcttgaaggtttgaacagggtcgagaaacttcgactgctccatggtagctggtttgcccgagaagaggcaagcggctacttcaagcgagaatggactccaatcattccgcttaggcctacggataccgtgcgacaggtaagagcctgggatatcagcggtacgcttccgtcagactccaacaaagagccagactggacagcgggcgtattgatgagcaagggccgtagcacgctatacacaatcgaggatgtggtgagggaccgccgccgtattggtggggtttttgaactgatccttgagacagcaagacatgacggagctgacactacgatcctgattccacgcgatccaggagcagcaggtcagcaccttgcatgggactttgttcgccgactggcggagcacggattccatgccaggacccgtccaaccaacaaatcaaaggtcacccggttcggtccttttgccagcatggcagaggctggaggtgttcaggtagtagaaggcccctggaacgaggcttacctgacggagctggaggtgtttgatggaagccggaatgttaaggacgaccaggtggatgccacctcggacgcctacacttatttggcatccgacatccacattcccaacttcatccctccggacctgacccgaccaaacccgctggccgttgaacgataggaggccctttgtggctcggagaaagaggaacgtcagaaaggcggcagaagtgccatcggccccccgccttcggctgggcgaaatcggacacacgggcctaaagcaaagcggtggtgcaatctacgaggaaactcgggctgagctacggttccccgagaacctgaacaccttcaaggtgatggcccgagacgccaccattgcaagtgccctggcattgttcgaattgatggtaagccgtgtagaatggagtgtcaagggcggtacagagcctgacgctgccatgcaggagaaggttaaattcctctcccaggtcatgcacgacatggaccacacatggtacgacttcatcaaagaggtgaccagttgcttcacttacggcttctcgatccatgagaaggtgtaccggaaacggacgtgggcaaacggctccaagtacaatgacaacaaaatcggcctgaagcgtctccccgttcgttcacaggagaccattagaaagtggcggtttagcgaggatggtagggacttcctaggtgctgtgcagtctcccaagcttatcagcggatgggagcaaagatatggaacctatctgaagaacctgcccaacggcggtgatgagattttcatcccgaaagagaagttcctgaacttccgtatcgaccctcgccgtgacaaccccgagggcaatagccctctgaaaaacgtatacttcgcctggagttaccggactgccctggaagagcaggaagccgtaggcattacccgagacatgaacggtatgcctaccctgtacatcccgcctcggtacatgtccccggacgcttccgacgaagagaaggcgatctacgagtattacaagaacgccatgcggaacatcaccatgaatgagcaaacgtcgctcattcttccgcagcagtttgacccggaatctcgcctcccgctgttcaagttcgagttgactagcagtcagggcggtaagatgtacgataccgacgcaatcatcaagcgttgggataacaagattctccaggtcctgttcgcagatgttctaaagatgggccaggacaacgttggctcctacagcctggctggtgctaagaccaacctgatggctatggccattgaagcacgtttgcagatgatccgggacgtgctgaacaacgacctggtacctcaactgttccggttaaacggatatcgccccgatgaagagttccccaccttcgagttcggcgacctcgacgagattgacttggatgtttactccaaggcgatccagcgaatgatgtccgttggtggcctagagtttactcgtgatgtggccaaccgaaaccgcaaggccattggcctaccggagcttcctgccactcagcctatcgaccgagaggctctgcccttggcaaacgacagcaaggcaggggaggggatgaagacggcgggtgaagggacttctaagagccccagcgcccgcgatgattcaaccgcaaaccaggataactgaaatggctgaagaaaaccagccgactcccaaagaggacgtggtgaagagtgttgacaaggccgagcgccgggcactctttgtcgtcctggctccggatgaggtggaccttcacggggacatctactccgcagtcgaagtggagaaggcatgcattcagttcaaccggcactgcatgaaagccaacctgttccacgccgtcgagaccgaggctgcccagatcgagcaaagcttcatcaacctggccgacttcgacaccgacgatggacggaccattaccaaagggacttggtgtacttggatgcacttcccggaaggtgatgcgctggcagatgacctgtgggcaggggtgctggatggatcgttcaacggcgtcagtatcggcgcccgagcaactgtagaggacctcaccgatgagtgatcgaaaagccaaacgccggctgaccgacatctcttttgaccatgaaggcgctcatctggcgctggtccataagggacaaggtggccctgcgaatgggtatacgaccctggtaaccaaggcacttgacgcgggaatcccgcaagacgtgctgaaagccaccaaggtcaaagtggagctggagttcccggagttcctccggaagttcttcaacatgtactacagcgatgcagagatgttgtctgctgccctggggtacggcaccactgaagggaaagattggcagatggacggagagtcgtaccaagagtacatcgaacgccgcgtaggtggcatcgagattctgaagtccctgtacaagagcgaggaccccgttgccggcttgaataagcttgacgacgcggcaatcgtcagcatcgcgaaagctcgtgacctgctggaaccccatatggccaccgcttctggggccgaccacaccaacaaagaggaaagccctgtgagtcaagaactcatcgacaaagctgtacaggcagccgaagcaaagctgcaagatgaactcaagaagcaagccgacctgctgaaggctgctaccgaacaaatcgccgccatggaagccatccagaaggccgctaaggtagaagctcgtaaggccgctgtagccggttccggtgctgacgctgaagctcaggttgagctgatgaaagccatggaaagcctgagcgatgaaagcttcgctgtcgttctcaagcacatcaccaaagcaaaagaagttccggctggtctggaccgtgaagtcggtctgagcggtgcatctgacgctgaaaacgctagccaggtagagaccctcaaggctctgatgctggccaagtacaccaagcaataaggtataggagcccatcatgcccgttatcgctaccgaccatcagcgcctgagcaactggctcaagtatgaatacgacccggcctccggcgtaacccgcgaagtcatgccgaaaacctggctggacccggctgtgaaagcgaccggctcggttctggacgctgacggcaagctggtcaccaaggcgaccgctgccaacgctgcctacatcctgatcgattgcgagcaccgcgccgctgctgaccagtttactcaggtcctgcttctggcacgtggctacgccaagatcgccgacgaaggtgtgatctttgcggacgatgtagaagccgcagacaaagaaaccgctttcgcagaactggcgaagaagaacatcttcgctgtacaccaggtataaggaaggaaccatgcgaccgattccctcgcttcagaacaacttcgaatacaccgacctgaccgagccgatgatcctgatcccgaacgtgtggggtctgacccaacagctcggcatcttcggtgttgaccgcaccacccaagagtctgtgactctggaagaaatcaccaagtcgttcggtctgatggaagatatccatcgtggcgctcgccaccaggttggccgtgactatgatcgtcaaatgcgcaccttcgcggttccgcacttcacctacgacgattacatcaccccgcgtgacatccagggcaagcgtgcctacggcaagcaagagctggaaaccctggaccaggttcgtatgcgcaagctggagcgtctgcgtggcactcacgccgctaccatggagtttgctcgtatgcacaccctggttaccggcaagccctacacccccaacaacaccgttggtggtgctaccggttacgactggtaccaagagttcggtaagacccgtttcgaagtcaacttcgagctggacaccccgaccaccaacatcctggagaagagcgagctggtttacgctcacatgcaggacgaggcctacactggcggcgtagttggcgatgttatcgctatctgctctccggagttcttcagcaagctgatcagccacccgaccgtggttgaggcgtacaaatactacgccagccagccgcagattctccgtgaacgcctgcgtgcccgtggcttcgacgcccgttaccgtgagttctacttcggcaacgtgctgtacatcgagtaccgtggtggcttccaaggccgtccgggtggcgagaagcgccgttacgttccggctggtgaagctgtcttcatccccggcagcggcaccgaagacctgttcaagaccttcttcgctccggcgagcaagttcgaacacgtcaacacccccggcgaagaaagctacgctttcgagtacgtggacccgaaaggtgagttcctggagatcaactccgagaccaacttcatcaacgtcctgatgtacccgcaactggtcgtgaaaggcaaagcggcctaagaaaacgggggccttcgggcccccttttttggtcccgagaaaaggagtaggatatgccctacacaggcgatccgaagaacaatgtggtcgatcagctccgcctgatggtgggggatatctgggacgacattgaaatcttgacggacgaagattaccaatattttatcgacatgtacaatggcaatatccgcagggctttcctggacgttgtacggtcaatcctcttcaagctggcacgttacgtcagggaacggactggtgatattgaggtctacggaagtgactggtggaaggcctataggcaaactctccaggatatcttgaaggacccgaacctgacaaccgtgattgctctgccctacgttggaggtgtgtcagccaaagacatggccatgaacaatgccaacccagacaacgtggcacggaagattttcattggattcaatcgtgatttgcggctttacgagcagcagaacgtagggtacaacgacatgccgagaatcgggaaggccctagatgcccagccgaatctctgctgactttcggaagctagacgctctgattgcccggatggaggccttggacggtctgacgctggaaggaggcttcttccctgaagaccggtacggtccagagaatggtaacctcccagtcgcccaggtggcagcctacaacgttttcggcacggaaaccaacccggaacgagacttcatgactcccagctttagtgactgggccacggtgaactactaccggaaagccatgaagcaggtggtagaggccaccattcgagatgggcggacccagaaggggcagctcaacaagatgggccgaaccatggtggagattatccaggtcaacattgacgacttcccaggccataacagcgctcgctgggcccaggtgaaaggctttgacgaccccctaacccatacgggcaagatgcaggatagcgtcaagtacaagatcgtgaggaggaagtgatgctcacgccacccatgctaagcactcacttcgtcaagaacgaggtgattcgccggcccaggaagcgcctggtccgaggacggcctgttcaagaccctccggagatttacattgtcgagggaagcttccagcctgtgctgaaaagcacggacacgatgcaactccctgagggtgaacggaccaagaaggctttgaaggtttataccaggaaccacaccaccctgagagaagccaacgaggctgaggatggctgggatgcggaccagttctggtggaagggcgagctgtacgaagtcgtgaagaccgcttcctacgatatgagggtcctggatcacgtcaaagccatgtgtgttcgtgtggagggtacctgatggccctaaccatggacgagctgagggcgaaataccctggcatagaggacatttacacccagttggaagatgccctctacaacgtggctgaggctgctttgggggatttccctctggtgctaagctactgtgataaccaacagacccagacgcctgcactgtacattgaaccgatggacatcaagtcggtattcactgaacaggttgcaggaactctggagattgaccctacagacccagaaagggctgtccaagaggtcaccaagtggtacacccttaaagcccgttttacaggcttgggaagtccacacaaccacgccatggcagcggcagcagtccagcatttggaattcttcctcagcactgaggatggttaccaggctttggaatccaacgggttttcaaagaatggggccaatccaattcgtcggatcagggatcaacgtcccaatgagctgtaccagcatttccggtacgatgttcatttgtcctacgccataacacggaaagaagaggtgacctggatcgaagctttggagctggacgcggtttacaccaacgccggacgagagcctgaccacgttatcaagaaccatatctcactcaacgaggaaccctgaagatgacccgtcttaccgacatcatccagatcaccattgatcggcaaacgcagccggtagccaccactgcgttcaacgtgccgatgttcctggctacccactccaacttctccgagcgggcgcgggaatatgcatcgacggaagctgtcatggcagacttcccggacaatagctccgtaatgcaggcagctcgtatggccttcgcacagaacccgcgccccaaccgcctggttgttggtcgccgcaacgtgccaggcgccactgtctccattgtagaggtcgcaccgcagaccacctacaccatgaccctgaacggtattccggtaagctacctgtcgaaaccggaacctgtcgatgaagatgatgagccggcagatacggcagtaaccatctgcgcaggcctggtagcagctttcaacgttagcccggttgttggcatcactctgaccgacaacaccgacggtaccatcaccgttcgcagctccagcacctcctggtcgctgactacctcggcaaacctgtcgaagtcgaacatgccgtccactgagggctggggtgccgccatcctggctgtaagcgctgcgaacagcaagtggtacggtgctaccatcgaatctcacgtcccggcagatgtcctggaagtggctgctaccatcgagtcgatgagtgcgaagaaaatcttcggtacctctaccagctccgtggctgtgaagaacgccactgctggcaacatcctggaaaccctgagcaaggcaggctaccatcgtaccttcctgctttggaatggtcgagctgaccaggacttcccggagctgggctggatgtcgagccaactgcaagagcagccgggcagcaacacctggagcttcaagggcatcgctggagctacctacgatgagctggacgaccaagagtcggcaaacatccacgaccacaagggtaacacctacgagttcgttggggatgccaacagcaccacgttcggtagcatggtgtctggcgagtggatcgacaccatggtaggcatcgactggtttgaagctcgcctccgggagcgcctgtggttccgtcagcggaacagcaagaaaatcccgtacaccaagcagggtaccaccatccttgaaacggatgttcgagcacagctccaagagggcattcgagtccaactgttcaccgacaccccggctccccgggtccgtgtacgggatgcaaacagtatggctccgaatgatcgggctcgccggttctatgacggtatcgagttcgaagctcagctcgctggtgccatccacatcatcggtatccgtggcgtagtcacggcttaaggagtagacaatggcaggccgtacttccacttacgcccctaaccaggttactatcgtaatcaaccacgcggcttcgggtatcagccacaccctgaccggcttcagcgaagacagcattgtctccgttgaacgcctggtggacacgttcaccgagtatgttggtgctgatgacactcacacccgggtgttcaacgccaactccggcgcacgggctaccgtaagcctggcccagacctcggagtcgaacgatgtccttaccttccttcacgagtttgaccgtgaagcgatgtccgcagacggcatgttcgagatgctgatcaaggacaactcgggccgctccctgtacttctcggacgaggcgtacattgcagtgatcccgcagggtggcttcagcaaccagatgaacacccgtgattgggtcatttccatgaccaacaccacgttccaacatggcggcaaccagaaggtgagccccgctaccgcagacaccctcacggctcttggtgtgaacctcgacgcccgctggctgtaagcgacaacctggccgcccctcgtgggcggccttttttgtacctggaggaaatatgaacaccttgacttactctccaagagaggttacgatcctgatcgccggagcccatgaagtgaccggatacgcggagggggagttcgtcacgatccagaaagaggttcaagcgacccagactcagcgagctatggatggatcagtggcccgcctctacactaaggatgacggctaccgaatgaccctcaccttggcacagtcctcgcctacaaacgacttcctgggcgctgtttacaacctggacgcagctacccgcaaggggaagttcccgctagtggtgaaagacaccctgggaaacacaaacttcttcgcaggcactgcctggattgagacccctccgaccgtagggtttgggggtactcttcgagaaaacgtgtggcgattcgcttgctacgacgctaccctccggatcggcgggaacagcgaccttactgacttcgagaactacctgagtcagggcgcagccatccttccaatccttcgacagtacggacttatctgatgacaaagcgtgtgttgacttacgcccccgaggatgttagactgataatctcggagtttgaatgcgtaggtgtagtctcggttgaggttgtctgggacatggaggtctaccgtaaagtggtgggcatccggggtcaggtgacccgagttcgaaacctcaaccagtctgcacgtatgcgagtagagcttcttcagacctcggacacaaacgatgtcttgttcgacatcctgacacaggaccgcgttaaccagtccggcaggctagacctggccctggctgacaacaacggtgataccatcatctacaccaacaatgcctggatttcaggccatccccagacccgtaggagcctggggtttgacaaccctgtgtggacgattgagattgcccgagtaacggaccgtgatctgtctggttcgaacaaccccctagacttcttcagcttcgacgggctgaagacggctgcgggtaatgcaatcaactcggtcttagaccaattctaaaaggagagcccaaatggcacgcaagcaacattccatcgaaatcaacggtgaccgtttcctgatcacctccatgccggctaccactggcctgtctcacctgaagatgctcaccaagcttctcggcccggcccttgcagaggcaggcgtaggctcgaaagagggtgcaggttcgatggacatcgccaccctggtcagcaaggtggttgagcggatcgacgaggttgaggtggaaaagatgatcatcggcatgatgaccagtgtgtccaagaacaacatggaaatcaacttcaacgaggagttctcggctgactttggcaagctgttccagttggtgactgaggtagtgaagctgaacttcggctcggtttttcaagcactcggtttcgacggtcaacagtaagtggggaggggggtgaccagatggtacacccccgcctaaagcggctcatgaaggagttccaaaaggactacgaggtctatcaggtgttgacacactctctgcgcctggcgagccttcacgagctgcaaacgctgtacgataccgaggatttatatgacctcctagagtaccaggcagctcacgacgaagccgcagacatcgcccgagaaatcgccaagctgaggcaacaagatggcaactgaagagattacaaagctcgtcgggacgatccagtggagggcggataaccgccccctgctgacgttcaagaagaacctggaacaggtcagagaccgcctcaacgaagtggctggcctggccaacaagaaagtgacgatgagggttgaccttgatggtcgaagcctggcagccaagatcaaaatggctaccaatgcccagattcgtctcaagaatgtggacatcgcccaggacacgctgggaacgatggtcaagaagctcagtgagcgactggcaaacactccagtcacgctgagcaatgtccgtttcaacatcaaggatatcgcccaacagaagcgattccttcgcacgtttatgcaaggcttggctctggaaattcccgtcgcgattcgagcgaggaaggcagagcaagccctgttggcatggaagcggcagactgagcaacgcttcacgcttcacctgaatgccgacatcagtcagtccaagttctaccgaaatgctcgtcggaccatcgacgcagtgattcagaggctaggcactatcactctgcggacgccaaatatcaggctgtcggttgaccgggctcacctccggcaagagattgcggatgtcctggcccagattcgccgagaggctagaattagaatcgatttgcaaggccatgtcaaccaggtaaggggcaggaatgcccatgctgtgggaggtatggccggtgctggtgcaggggctgctgtagcccactggggacgaggctttatccccggcctggggggcgcgtttgccatctcccagatgaaccagatgggtcagcaaatgatcgcccagcagaacgccatggctgcggtaggtggtagccaggaagctggtcaagccactatggcacagttcaagcagatggccaacgaggtcggcttcgactggcgagctgttgcaccttcctacaccaagatgctggcctctggacagggcgccggaatggacaaagatgttgttgacagcatcttccgttccatgacagagtatggtaccgtaatgggcttggataccgagtccatgaaaggttctttgcgcgccgtcgaacagatgatgaacaaagaacaggtgatgtctgaggaactgaagctccagttgggtgaacggttcccggcagctatgagcctcatggcccaggctgtttctgcgaaagaaggcagagagattagcaccaaagaactcggtgatatgatggcgaaggggttggtccgaacggacgtgctccccgagttcgctcgtatcattgccgagaaggcccgagaaggcggtgcgttgtccagggcgcagaactccactgctgcccaacagcagcgctttaacaacgcctggtcggacgctgtggggctgatctacaacaacggcatgggccagggcatggccaacctgttcaaggagatggctcggacgctgaatgataacgaggaggctgtaaaaggcctgggtgctgcgatggagtggctcctttccccgtttgaagcagccgctatcttgattcgtcagatgctgcaacaactacccgacctggccagcaagctgggactgacatctggacagttgatggctttggctggagctatcggccttgcgttattcccgttgggccagattgccttggctatcggcggcctgttcctggtggtcgaagatttcgtcggcttcctgcaagggaaggatagcgtaattggcgacttcttcaaccaactgacgccagagcagcaagctgtgtggctgaagatcggaggggcagtagtccagacagcagaggctattggtcgcctggctgaggccatgggagagctactgggagggttcgctgagggtggtatgttctccactgcgctggacttcttcacgtcgaagattctggccgtgctgacagtcatcaccaagctggttcaggctgctgaagccctgaagaataaggattttggcaaggctgcgaagcttgctggagacgccggggccgtagcgctgtcgaacagcccggtaaccatgctcctccgtgatgacctccggcaggaccttgaggcccgagcccgacgtgctcagaatgacatggggcggaacatagatgaagacgttgttcgccgagtccctgagtacctcaaagcggagaacggggtgggtggtatgcccagcgtagggcagattaccctgaacatccccatccagattgagagcgctcctcaaatccaggatgaaaaggagttcagcgagatgcttcaaacccgaatcatggacagcttccatgacactcttcgccaggccatggtggatgcatcggagaacaagaaatgacggtagctattcaacgagagtccggggatatcatctggttcgatgcgattctgaacctgaacatctcccgggctaaccaggtgactcagcacgtggtagaatcgggagcttcggttaccgaccatgtgattgctcagaatcagaagatgaccctttcgggggtcgtctctgacgctgacttcaacctggacaggccagttattacggctgctgacgcacaggctttcgggatcacccctaagccttttgtcaatagtacgccagtgacatcgggccccatcatcaccccgggggcagacacggcctggacgaacttcctcccggagacggtcaaccagttcttggacctggacaggcccaccgtggtggttccagcggctcccaaggagaagggggcaaacctgatccgagaagaactggacaggatcaccagggaccgtgagaggattgtcctgctggacttcgaaggctctgctgtgaggaccatcttccagaacgtggtgatcacctcgatcagcttcaaggaagacccgcagagcggtgagtcgttgtatgtggacctggcatttgaggtgatcaggacaaccaccttccagacggcagccattcccaagaaggtgagcgattcgatcaagaacaaggccagcgagaagcaggccaagggcaagcaagccccgaaagatgagaaggtaacggatgcagacgggaagaacccgaaaggggaaaccgtattgcacaggatgactaaccgggaggtgcgatagtggctatccgagagcgggccaggctggtggagctacccacttaccgagacccacaatacgcctaccaaatgaagctgggggaccaaatccggtacctcagcttttcttggtcggataggcaacgatattggcacatgaccgtagaaaacatggacggagaggttatcattcggaacatgaagttggttccgaactaccctctaggctatgactacggatgggccaggtacgggctgaacgggtatttcctagttctccccgacaaccacaagaacgacatctgtgaagatatctctactctcaacgagttcttcgaactgtactacgtggagattgaggaatacgacgatagcgaggaggtgtaaatggaacagttcgaacgggtgtacttgctcaccgttggagattaccggacaggcaagggagtcctgatcaaggatgtacacatgcggttcgacatcagcaagtcggcagacaacaagaagaagtccaacagtgccacggtcgaactgtacaacctctcagcaagcacccgagcaatgcttgatacggactatttgtcggtcaaactggaagtagggtatacggcagccggaacccgggtggtactggagggcaacgtggttgaacgccggactgcccagcagggcccggacatggtgactcagctcatcctgggtgaggggtacaccgacctaaaccacatccggctcaagcagacgattcctccggggcagactgccaaggatgtcattgaagctgctatggggcaactacccggcgtggtacggggtgttttttcagggaccaatatcaacaaccccgtggtgttcgggtatcccatggacgggagtgcaaaggaaatcttgaacgacatttgcagggacaacaatatggagtggcggtgtgatgcaggcgccctctacgtcaacgatgtcaacgggattcacgacaaaaacatcaagtcggccccggtactgaacgaatctactggcctgatcggtatcccctaccgaacatcctctgaaggtaatcggcagaagggagacaagaggcggacgcaaggggttcaattcaaagccctgttgaacgctgactttgctcctgggcaagtggtccgtatcgagtcaaaagaagtgacaggctggtatcggatcaactcagccaggtactacgggggctacgatgaccaggaatggtacgttgattgcttctgtggcaccattatcgaggaagacctcagatgattgaactaagtttcagcagcgtggtgaacacgctgatcgagcaacaactgaacaatgtgagaacagccatcccggggagggtcatccgagtctacaaagacctggagacgttgatgattgatgctcagcccctggttaaccggctgtacgatgacgggacttcagaggagcagcctaccattctttccgtgcctgtgcaaatgccgggaactcgaaggactttggtcagcttccccttgttccccggagatgaggttctactggtcttctgcgagcgaggcattgataactttaaagccggtaccgggaaccccaccaagcccacgggctctcgaactttcagtggacgggatgctgtggctattcctggggtcttccccttcgcagtcagccccaataaccctgcacacaggaagttccctcacagcacctacgacctggtggtagcccacaacctggccactgcaacggagtgcgaggtaaggctgaaggagaatgggaacatcgaactcctgacggacctagacgtgagcgtcaaggcccggaacatcactttggaagggtcagaagggattaccctgaacacaccggccctcaaagtccaggcacagaataccacctggacagggaacatcacccactctggaaactacacccagacgggtgtatcgacattcaacggcattccgttccacacccacgtgcatggaggggttatgcctggcggtggtactactgccgtcccacaagcgtgagggattatggaccttctactggatgaaaatagtcacgacatcgtgttcgtgaatgggcagacccctgtgactcaggggcaagtccagattgtagctcaaaggctcaaaatcaagctctggacgttcctgggtgagtggttcttgaacctggacgtaggggtgccctaccgccaaagaatcctcaccaaggtggcccacaaggcgacggtggacatcatctttcaacgcctcttggctgaggatgagggggtgaaggaaatcctggaatatcgaagcgaatacaacgcgcctgctcggcgcttcaccttagaattcaaagtgcggacttactccaacgaagaagtagccgtgcgactgccgctggaggtataaatggctggattgactgacaaagggctggaaatccggtaccttcctgaggtactggagcagtaccacaaccgagcccaggacatcttctctgacgaagttgaacctggtgatgtagtggataccagtgagaactctaccctgggccgcatgattggcgtagtagccccaagcgtggctgagctgtgggaagccctgcaagaggtgcatgacagtttcaaccccaacgtggcaaccggctacgctctggataacgaagttgctctctcgggtatcatccgatacgctgaagagcccaccagggctcaagtagtgtttgagggtaactacaacatcgtggtcagctcggtgggctctgtatcctccagtgtcaccttgaggcagttccgggtgattaccccggtattgatgaaccttcaacaggcctcaggggtcgcctggagggtcacagctgttgaagctggacacgagtataagatcggttactcgacggacggtggcagcaactttgtatatgccacgtacaccgcgacacccacggacactgcaacgtctattcagaccatgctgggtcaaaaggtatcgcagtcgtggaccagcttcgaaacacagactgatgccaagaacaactacaactgggctcgtcgcaggaatcgtctccagattgtccacttcgacctggacccccgcatcaccccaatcaaggtggccaaaccaggggtagtagaggatacccaaatggggccatcgactcaacttccagggacgattgacaccatctcggtgccgatcctgggctgggattcggtgtacaacccaaccaacgccgtatccggcaggttcagggagacggatgtcgaactccgggaacggtggaggaattctaagttctaccaggccgctgccatcttggaagcgatgctggacggcatgcaccaggttcctggggtgcgggatgtgaccatcattgagaatgacaccaacaaccatgactcggtgcataacgttcctccccacgccttcacggtgatcactcatgggggtgacgactctgacatcggcaagatgatttggcagaagaagcctacaggtatccaagccttcggggatacggtggtgcagattgcggactcccagggcaaggttcactccattggattccgcagagccaaagagattgaggtacaggtcaacctaaacatctctgccattgcaggtcaggttcttcccggggatgtaaaggagcaggtcactgctgccatcctggcgtaccaagatgggctggacaaaattggtaaagaggtggtatactctagactatacactccgattaacagcgttccagggttccaggttaacagcttgaccattggaaagaaagggggcactcaggccatggcgaacatccctgtagggtatgacgaggtggctattttcgatgctacccgtattgcaatcacggtgacctgatatgctggaaaagaaccagttccggatgattgactttctgaaagtcgctcaaagccggtacacagagcaattcaagaagaagccgatcttcgataagttcgtagagctgcttcttcaggctcaaattgaactgcaagaggttatgcgccaggtccagcaagagcggaccctggacacagcagtaggggctcaattggacgttctgggggagattgtaggtcttccccggagccttgtcactgccgagatattcaaattcttcggctacaaagaccggcctgacaacccaaccccgctaccgaccccgcacaacgctggaccttacggttccttgaacgacccttcagtcggggcaccttggtggggtttggggcaagctactgagatttcccgggaggcaacggacgaagagtaccgcctgatgatcaaggcgaagattctgaagaaccggacgctatctaccccggaggatgtgatcgaagcctacaagttcctgtttggagctagccagatcatcatcgacgaactgggaaacgccaactgccgcatcggcatcgggaagattctttctaccgtagaaaggggtttgctgttcgagctgggcaatgtggctagcctgttgcccaagactttgggtgtgaactacacctacttggaattctctgctgaccgcccgtttgccactgaaggcttccagggagggtttggcacaggcgacctgaacgacccctcggtaggtggtattctgtcgaaccttctaacgtaagagagcaaaatggccaatatcaacaagatcagtatgaacctgatttggggtgtctctggtgatatcaccgccccaggtccggaaaagatgaacaagggctgggaggtggaggtagtcccccggcagtggttgaactacctgcaaaaccggttggacaccaacgtggcctacctgctccagaagggcttgcctgagtgggacagtgagaccgagtatcaggcaaacacctcctatgtacaacgaaacggtgtagtgtacaaggcctctcggacaaataccaacagtgagcctggcacgactgcgggaaacaccaactggaaccgggctttccaagagtggtctccagctctggagtccctgacatcgcttacccccactgcgtggagattcccgttctacaacgcttcaggacaagcaaccctgggtggtatcacctcctacactgtagggctcatgggccttagctccgatgcagcctggcgggcagagctgaaagctcaaacgagtgcttcccagctcacttggctgtccaacctgacacctgtggctggagctatcccgtatttcaacacggctacctccatggccaacctggcaacgaccccgtttggtcgaaactggatcggcgtagcagatgccgcaacgggcaggtcgcagcttcaacttggcagcgctgctgtcatgacggccacggctattaatcaggcgagcacagttgttgccagggattctacaggaactgccgccatcgggacggtgattggtagcctgacaggtaacgcttcaactgcgactcgactgcaaaccgggagaaacatcaacggtgtcctttttgacggaacccaggatatcacgctcccacctctgacagccgattacgcaggtatagtggcccgcctccacatcaacggggcgaacatgtcagggactgataaaacaacccagttggcactccgaaacaagtctaacacggattggatcagtctggctgtaatagaagataacatccttcagtttgctttccgaaacacttcgaaccccatcgtacagattgggggagaagtcgttctccacacagggaaccagttctcccttggaccaaccctaagcgatgcccgtagtcgtctaggacttgaccgagtgtcccaagggtcgtccgataccgtggtattcgctagcacgttgaataacggtccgtatttgaccgtccaaccttcctctgttggaggttttaatgggggaacgcagacttggatgttccgattcgatgaaactgggacactgacccacgggacggtaccagttgcaagagtgtccggcctggcaaactctgctcagattcctgccgtaactactgcccagtctaactccctggttcaaagggattcaagcgggagctttagtgcggtaggcatcaacgcctacggaagcattatcgggtatggatcgaacattttcagccgctcctctggtacagggaatgcccacatcggtttccagaaggcagatgggagtgagttgggcctgatttggggtgctccgtccaacgggtccatgaacttccggacgcagggtggctcgacaggcatgactcttacaggtcaagacttgactgtagttggaagggtcaacgcagccacgctcaacgcctccggaaacgctaacgttttaggcaacgtgaacgtgggaagtgctaccctcaatacggcaggtaacatcacgggtcctgcctacggggcgtacaattccctgaccaactgggtggattcggtatatgccaagaagggtgagattcctaacgacattgcccgagctggagcagcctgggacgccgtagggcagtacatcctggcaggagaccagtcacgcgggtcgggaggccctggcaccattagggcagggagccaactgaaaccgtactctaccatcagttacaccgcaggggcacttccggcagccgggcagtaccgttgcatgggagcgtttgcagggcgtggtaaccagatcaccctgtggcaacgcatttcctaaccaaacaaggggcttcggccccttacttctacctggaaggtgaggatgaaattcagaaacgttgtaaagtataagatggggtatgagtgtgagattaaacacccggaatgggggtggtcaccgtacttcgcctgcgactacgacgagaatgctaaaaagatttatgacgccattgtgtctgccattgaggcgggtgacatcccagtcccggaagatgtgtctgaccgggatttggtcattgatgcccgtaactggagagataatgaactacgagatgcagatcgtcaagtagaaatggccatagacgatgaagatgcggtcaaagagaaggcctggcgaaagtatcgctcagctctgagaaagtggcctgaaaaggcgggattcccttccgcaaagagccgcccgcgccgccccaagaattgaggaaagattatgccgcttccaaaacctgacgacctgtccgtaatctgggcatctattgggcaggcgactaagcctgctccaaacaagatcatgacaggctggaccaacgaaatccctccctaccaatggcacaactggtatttccagagggtagataaggccctggcccacatcaaccaacaaggcatcgccatgtgggatgccgccaccacttacgaagggggtaccagcctggccaaagggtcagatggggtggtgtacaaggccaaacggtccagccgaggtgttgaccccgtatctccggcaagcaacctggactgggaacccgcattcgagaggtacggtgaggctgcgaaagtaaattcccagcttcaatccttgaaaaaggattatgaaacactggccaatatcagcaacattgccatggccaggcaaaacctctcggtatattccaaagccgagacggatgtccgatatgccttcaaggctggggcagccgggcaggtgtttgctgtagcccctgccaccgcagggagccatgcagtaccaagggatcagttgccatccttgtacccccgagcaggcgcggcgccgggtattatcgccctggcaagccaagcggaaggatacgcaggcaccgttgagaacaaggcgattgcaccgagtgtcctgaaagcactcaccctgtataagagccagaatctggcggacctcccggataagcagcttgcccgggcgaacctgggcctggccagctctgctgtgttgccggaaaacacctggttgaaaactgctagcaacctggctgatgtccccaacaaagccgcagcccgtgccaacttggggatcacgtcttcagcgctcctccccgagagcacctggttgaaaactgctagcaacctggctgatgttcctaacaagcccgcagcacgggctaacctggagatcacagacactgctacgctgccggttggcgacgtgatgcgtaagagtcagaacctggcagggttgaccaacgttcctcaagcccgtgccaacttgggtttggggactatggcaactgccaactcgggagacttcctaacctcggcgaacaaccttggagatgtcagggatgcacaagcagcccggaacaacctgggcttgaaaggatgtgctactctggacgctctgggtctaccgaacggagcaactggcctagacttccaatcggaacaatcctccagtgcatccggctgggcagctcttccgaacgggttgatccttcagtgggggcaagggcctgcattgtacgatgatcggtctacgattgtacggctgccacgcccggctcgaatcctgaacgtgagcgtaactgtgatgggcactttcaacgcctctatcgggcctggcgcctacatgacggaccagtggagtaatactcagttccgtgtatcgtgcaactggggcaactgggcgtatccgttctgctggttcgctatcaccaccatctacgggatgtagtatgatcaccgacagagagtatcagcaagctgctgagatgttgggggtagatgtcccagcaatcaaggcagtgaccaaggtggaggccccggtagggggcttccagcctacaggagagccaacgatcctctacgagcgtcaccagatgtaccgacagctccaggccaaagggctcccaacggaaggtcatcccccagacctggtaaataaggtagctggtgggtatggaaaatacagcgagcaacacgctaaactggcccgtgccgtaaagatcgacagggacagcgccctggagtcctgctcctgggggatgttccagatcatgggctaccactggaagctgatggggtaccctacccttcaagctttcgtaaacgccatgtacgccagcgaaggagcccagatggacgccttctgccggttcatcaaggcacaacccaccacgcatgctgccttgaaagcccacgattgggccaagtttgccagactgtacaacggtccaggctacgccaagaacaagtatgacgtgaaattggagaaagcatatgctgaagctagtggctgaaaaggccaagctgcaccgtagcagtacagtggtgctgagcatcttcctcttcatcctctcgatgctgatcatcttcgagccgctgattcccgggcttgcaggtgttctcggtcccgacctataccccaaggtcgtggcaggcgtctccatgctgattgcagcaggccggtacatcgtccaaacctccctccggggtatggtagttcaagtatcggatgagattcccaaggaggaagaggaaaaatgaaactgatgactgccatgcggatagcgttggtagtcctcgttctggggctctcctggcttctccgggagagtcatcagaaaatcgacaggctggagcagagcctggcttctctggaggccagctacgcagaagcatcggcatcgtaccgatccttccgaaagcaatgtctgtccgtgttctcaatgaacgaggaactggtgattcaaaacaagaccctggaggcctctgtgggctccgtggtacaacgtttggatcggacccctacactgaccctacccgaggtgaaagatgcgcctacgagcgttcctgggcatgtggctgctgagcgtctctctcctgggactatggagttgctcaacgaagccttctgtgccgcagcccccgcaggtcatcctgcctgtgctcccaaatgagtggacaaccccctgcgtaatcttcccggtggaagaggacacggtaaaggccttggccaaggggtacgtcctgaacactggtgcagcaggttgcgccaacaacaaactccacttcatccagcagtggtacaaagacctggaggcccagtatggcagccgcacgcagtaacaacgaagactcccagtggaagtatgtactggacctggcagcaaagttcctcctacccctgctgatggcatgggccacctggcaacagacgcagattggtaaggtagaggataggctgtatgccctccaagctgttgctgtgaccgagcaaaaactggttgccacggaaagccgtatcctgaactacctggatgttcggctaggggacctggacaagaagatggaggtcaatcagaaatactccgaaatgatcatccagatgatgaagcaggagcggtaaacgagaggtgtcctcatgacgaaggcccacgaaatcaccgtcctggggatgctcttcgctacactgctgactctggtggtcggtttgggagttctggtctactacgctcaacgagtgaccagcaccgagtaccagttcgacatcatccggaaggagtaccggctcagcctggaagagatgcggcgagacttcgatatccgaacaaacagactgcaagagcaaatcaatgccatgcagtataccacgtctaagcagatgcggctgcttcaagaagagcaggacaacctcaagcggaaaagatgagccccactggccacaagctggtggggctttttcacgcccggagaaaagtagttgacatcccccacaacaccctatacagtggccacatcaacagcttgaggaggttccatggataaggtttacatcgacgcaacatttgacattgaatcggtgatcgccgagccggatgggatagtgtactcggactaccacaaagggactcccttaggagtaaccgccactctccgtgtgaacatgcccaaacgggattccaacagggtgtggaagactctcttggccatggatttctcggccctggagcagcgtgtattggcagccatgctgacttctggagggttggttatgcttctagaggatggtaagctgtacgatcagaacggcgcccaggtagaggacccccgtgataagctcgtggtgatcttcgatgagtgggacaagctttccaaaaatcagcgccacctgcgcgccaagaagcaccgtacagcccccaagaaccctcaactgcgaaagaatcactggaaccgttgacacaggaatataaaggaggaacaatgaagaacagtacagcagccctcggactggcatgtgcgctggcaacaatgctcaccctgccatccccgtaccctgctacgctgaacagccggtgggaggttgaagtcccggcccaggaggaatcgaccgacaagaagaaggccaagaaaaagaaactgaaggcccttcaagctgaagctgttaagtcgcgtaagggaggtaagaagtgactaaaccgctcgatccgcctccgacagtggagtatgttcgaacgactcggaaggcccctccaccgcctcctccaggccctgctgtgaggtgggtgaaagaagggacgactttggatgaactagcgagggatttgaaattgcaacatatgaaagcatggtctgtcgtggttttagcagttatcctggcactcaccatgatgttttccttcctgggcatgatgcagcgcttggaagagaaccaagtgaagctcgaatctgagaaggtgcaagccgtgaaagaggcaatcaccaaatgcgaggcgggagctggagtgttggaagtgactctgaaaggagaccggctgactttctacacttgcaagttctcgaagtagctattatgattccagacctcaaggaggcttaccagaaagcctccaagaggactaagctgttgatactggcggccctggttagccaagcagcgatagccctctacgaacaagatcgaaggtctttaaaagacccccacctgtccaggatgtgtttcgtacaacaaggggtttttgaagttacccgaacaggccctatcacccgcatctattgcaagaaaggagagtaaagatggtaattttcaccaaagaacgaaacaacttggccaatagcgcaatgatcgctatcaaccccaaacacgtcaccgggctggaaatccctgcgtcgaaggaagaagtccgagtaggcctcacaagcgggattattatcctgagcttcctcacagcccaagatgccaaacaagccttcgaaactctgactttcgcctgctaaggaggtaccaatggaactcgacatccgccaacccaaccctcccttcgataccatccggattgcggatatcagcgacgatatgagcaatgtgtgcctgatcacgtgcaaagaggcccctcccggagctgtgcgcttggtgtaccccgatgaaggacaagctacatttggaatgccgggagatatcgtgcaacaagagcttctggtggaggacaagatgcacgccgacttccttatcaaggcgctggaaaaggctatcgagttggggtggctgaagtgatgggactgccgatctacctgagcgttagcgtctaccacttggcaggccttatcgcagtcgcctgcctggtctactggggtatcataaagatgacccggagcgaggttgaacgaggaaacatgaccaagccgcaagcgtcctggtggcgtaagtggtaccccgtgtgggctatcgtctgcatctcggtatcgtgcctgggcttcggctacaaggtggaagagattcgcccggtgggcacgttccaatcccatcccacaactgttgacacaggggagaaggaggagtatcgtgcataccgtgaaaaggcagaagagcggttcaacaagacccttgaagccatcgaaacgaaaaacaacctgaagtaaggaggaaagatgttcaagaacctgatgcgtggcgtcgccattgtcctggccctggccctggttgcaggctgctctgatgtggtaccgcctgccatgaaaggcaagcacctcagcggtagtggctacagcaccaatgtcctcgaacctggccgtcactggcgtgccccgtggactcgtatcgtgatgctggatgtctccacccagaccgtcgccgagcccctgaaagtgaagatggccgacaatctggacctgacgttcgtggtacgcttccgtactcgaatcgcaggcaccgagcgaaccatcaatgccatgttcaacgatatccgggtggagaatgaccgagtaactctccagcaggtgtatggagtctacggtaaggatgtggtacaacgtgtcagccgctcggtcctgggcaagtaccgcacccaggatgtggcagccaacttcgacaagatcaaccaagccctacactcccaactggtagcagcaatggagggtagccctttggaggtgagtaacatcaccctggctgacctgcaatacccggaagtgatcacgaaggctatcgaagctcagaacgagcgagagctggctatcaagaccgccgagaacgaacaagctatcgagatggtcaagcgtgagaacgccctgaaactggcccaggcggatcgtgaaatcgaactgaccaaggcacgtactctggctgaccagaacgaaatcacgaaccgtggcctgtcggagcgactgctccagtacaaggcgctggaagtccagatggaaatgaccaagaattcctctgcggtgttcgtaccctacgaggctctgaccagccccggcttccagaaccgcgtctacaagtgaccaacaggggccagccaggctggccccatttcttttgaaggaggatgcatggaacataaagcgttggaaggtgttaaacacagaacgtgggaagtggtggatagtgagtttgatggagtttacattcgagaagccctccctaaagtgaaggggggatacctggtagagtacgtgattgcctctgatgttaaggaagagcatgctgctaccctgtgtgccgctcgggagctgaaagcggagctggagcgcctgtgccggatgagtgagtccagctttatcctcttgggctgggaagaaaaggacattaagagcgtcctcgctcccgcaaaagcagccctggccttggccaacaaaaactgggagaagtaagatggacgtgatggacgacgattttgagttccctgatatccttccggagtgggctgaagagtttcacccctcggaaggcaagcaccagataggggcacagttggcgactaaggatggacgagttaccgggaatggggttatcttctgggctgtgccgtggaaattctaccctaagcttgacctgttccttgtggtgacggatgcaggaaacgttctcaagttgaccgagtacgagttgaacagcctcttccactggccacaatatattgccgacctcaaccaaccgactccggctgaggtgatgtatacggtaaagacaggaccaattggggaccttattcaagacttcaaggaggaaaacggacatgcgtaaactatcttcaattcgtcaagtgtcaggtatcgaacccatcgagggtgcagaccggatcgagaaggccttcttcgggggctggaccaccatcgttccaaaaggtgtgctgtcccccggcgacctggcagtctacttcgagattgacagcctgctgcctgtggcagacccagcattctctcacctcaccaagaacctggtgaaggttacccggaagaaagagtcctgttccctggggatgggttgcgaggtggtgggagcctgttatgcctcgtcgcaaggttgccctagtgagtgcggtggcgaagaggaggtggtatactctcgcctgcggactatgaaaatgcgaggtgtcacctctcagggtttggcccttcctctacgagccttcccaggccgcctggcacagttggaagctggcatccttcgccggctacagaaagcgcccgtgcaagaggtgttggacgacctgaatgagaagatgccgctggatgaaatgctcggcgtgctgaagtacgagaaacctgaagaggtggaggcagggaatagtaatgtctcccgcgccagcacgttcccctcatacatcccgaagacggaccaggaaagggtccagaacatcccgctggagaaggtcattgcagatggaccatatcaggtaaccatcaagatggatggctccagttgcaccgtatgggtgaatgaagagggtgtgggcatggccagccgaaatcaaacactcgtggagcccacctggacgaatttccccagcttcgaggattgcaatcactttgggcaggccgtcctggaccaggacatcccgcgcaagttggcagagttctatgaactcagcaaacagccgttcgcaattcaaggcgaggtgtgtggcccggctattcagggcaacaaggagaaactggagaaacctaccttcttcttgttcagtgtcttcaacatcaaggagggtgcctacgagtccccagagtattgcaggatgctggcggaaactctcgatattaagcatgtgcctgtgctctcgactcagcatgtgtttgaagatgtcacttatgccgacatccttgccatggctgaaggtaagagctataatcctgccaccaacagggaaggccttgttttcacagcggtagacaagaaccgctacggtcactacccccatttcaaagctatcagccaatcttggctggcgaaacacgagtaaggagagtccatgcagtcgcagttccaaaacatcctgaaatccctggaaatcgctcgtcagattcgggatgacgaagagttcgcccggctggtcgagctgggcatggttcaggcggacattatgaatgagtcgttctactgggttgacatgcagggccgtttcaggcagtatactcctcacggcttcgaacactgatcaacatggcccggctagtccgggccttacaggaggaaacatgagcgaaatcaacttttatcccgtatctgctgagaatatttaccccggcctgacccaggcggcaaagatcgtcctgctgatggttctgcctgagcttcgaggaatcatctgcccagacacaggtgaacgtctgcgggagggcttgggaatgcatggtatcctggagtgcgtatgggaaagccgccacaaggttcatgccatggaccagtgggccaacttcatgcaagggtacaagtccgaaatgccgggctccagcgacatgtatgaccaaattcaacgagtgttgccttcccggaacatgctgaaacaaatgatcttaccgtacctggaggcttgcaaacgtcaaacccgcgaagagcgtatcgcacaggagaagtaccatgagcaaatttgaaactcttgacctggtatgccttcatccggacccggaagtgtccggtagcaagggaactctattcggagacttccgggaaaaaggcgccataggcatcgtgttctacgtcccccaagggataagcacaacgggcaacgtgaaggcccttgggaatgaaaaaggatacggggtcgtctggcatgtggaagggcgcctacgcgttatgtacggagtgccagaaactgacctggtacgctacaaaggccttcgccaggaagatgagttcccgtgggctgaactacctcttcctggggaggtcatctacttccgagaggaggggtacgtgaacggggtaggcggtactgcaaagaaagccccgtatgacaccatttcaactggagccgtgtatggctactcctcagacctgaagcttctgctggtatcggtactcccgcacggagatgaggaggaggttccggtagagaacgtggtgggcctgaagctggggatcacagaccgtatgatagaggagggctacctctaatggcaaagctgaagctagatgggaacatcctcaccgtgatggaactgacggcaggtcaggccgtcgagaaggtgaagcaacgcattcggatggatgttgactttacccaggtaactgtggtacagtctggtcctggagtattccaagtctcttaccctctgaacaagggtgagcgtggaagctacaagcacctctatgacaagcaggagaaggagcgtaaggcgaacaacccgcctcccgagccaccacccctcctgctggcgtaaccctcagggccctccgtgggccctttttattgcagaaggagtaggaagtgctgattgggaagttcgcctgtgtcctgccaggatgtgatagcagcgacgctatggcggtctacgaggacgagccgggggtcttcggtggacgctgtttcagttgtgatcgaatggtttcgaacaacaccctggcaaggtctcccctgggggaagagttgggagcagtgatcatcaaaggtgatcgacgtgcccaggcccagaggaggaaagaggagaaagaagtgagagagattcaacgcaagcccgtcatcactgccgaagaccgggagaaaatccaaggcaacggcggggctgacacgaccctgttccggggcatagcccggcagaccaacgagaagtacgggtgtatcacacactacgcagacaacgagcctgtggtgcgatattatccgatccatgaccacggtgagctggtaggatacaaggttcgtcaggttcccaagtccttctatgccatcggtcggaacgacaaacactgcgagctttatggtcaacacctgttccctgccggaggcaaatacctcctcattgtaggcggagaggaggatgctcatgcagcttaccagatgctccgagttgatcagctccagcgctggaagaagaagaacccttacgcggacatcgcagatgcaccgttgccgtatccagtcgtaagtccgactgtgggtgaaacctcggcagccagccagttggctgccaactatgagtacatcaactctttcgacgaaatcatcctcatgttcgacgcggatgagaagggagagcagggtgctcaggcggcgctggaagtgctgcccatggggaaggtacggattgccaacctcccagggaaggaccccaacaagatgttggaggacaagcaggccaaggcgttcatcaatgccttcttcgacgcccgcaaggcatccccggcaggcatcgtggggtcgggtcagattcgagaggctatgcttaacaaggcaatggcgcctaagctgcccctgccctcgttcctgtacgagctgtctcggaagaccgctggaggtttcccgctgaactccatcgtcaacctgatcgcaggctccggcatcggtaagaccacctgggtcaacgaactggtgtaccattggattttcaacagtccttacaagatgggcatcgtcaccctggaggccgacattgcagagtacgggggttatctgctgtcccggcacctgggccagaagctggccttgattgaggaccctcaagagtacctggcaacaatcgaatctgacagggtagagcaggcgagtaacgagctgttcctcaatgctgatgggtctgaccggttcctgctggtagatgatcggggggaccacgatgcaatcaagcagaagattgagcagatgatcatttctgggggcatccaggtgatcgtccttgacccaatgtcggacctgattgacgggatggacacaggcgaacaggcgttgttcatgaagtggcagaagcagatggtgaaggcttacgacgtaatcttcatcaacgtcaaccatacccgtaagggcaaggacaacaagactgctgcaagccggggagctgagctgagcgaggaagacatcattggctcctcgaccatctacaagtcgggcaacatcaatatcaccctggtgcgaaacaagcacgcggaggacgatttggaacggaacaccaccctggtgacccttaccaaatgccgccacacagggtacaccgggccagcggggagggtcctgtacaacatcaagacacacaccttgatttccctgacggacttcctcaaccagcaggtggaggagtacaaccaggtacatggagagtctgaggggttagagcaataccctgaagcagagtgtgtcgagcaagttcattcgccggaagatgtggctcccgtctaccctcagttggacggcccgccgccgaccggggacgatgatattccgttctgacggatgaaaggaggagtaacgtggaagaggtacagaaacgccgggtagtattcgatatcgaggctaccgggctgatcggggaggggacggtggactacaccgcctcgccctggcgcctgaaagaggatttcaagctacactgtgctgtagcccgggacattgacaccgacgaggtgttcaaatggggccctgacgaggtgatggacttcgccaaatggttgggggaagagtgctcggtcgtaattggccacaacattatcaactacgacttgctggctctgaagctgacatgcggcctggagtacaccatcgggtggggagagaccaaggacaccatcaacggtaaccccgtcaagatcgtggacaccctggtaatctccaaaacccttaaccctgaccgtcgccctggccacggcattggggcctggggtgacaagctgggcctggccaagatcgattggcgtgcgaaggctgttgaactgggactgattaccgagaacgcccctcgtggtgcagagttcaagacgtatcacccggagatgttggagtacaacgtccgagacgtggatgtcaacctgctggtctacaaagccctgatggcagagtggggtgcatggaactgggctccggcagtccagaccgaaagctacgtggcttgggtggtgacccgtcaaagtcaccgagggttcttcttcgacgagcgcctggctcaggccaacgtccgggagctggatcaactgatggaggagtgtcgtgccattgttgaaccgatccttcccccgaagaagccgaccaagacggaagcggccaagtattgcttcccgaagacccaggagaagaagatcaagggtggtctgggactctccagcaacatggagaagttcctggagaagatgggcggtaagcaccttccacgttcggggccggatgctcccaactacgtggaaatcaacggcaggacgtatggcctaccgttcgatcatacggtaagcttgctcactgaggtgcctgccaagatcagcgatacaacccacatcaagggttggctggtggatatgggatgggacccgacttcgtggaaggagcgtgatctttcgtcggatcagaagacaaaggcccagctacctttcgagaagttcgaaaaggtggtgacctcgtacatcgagcaaacctatgcaagcccgttcaagaagtaccgcctggagcacctgaaagagaagctgcgtgctaagtggtccctggccttcatgatggacaacccagatattgttctggagtacatcctggagcgaggcaatgatcgtcagttgaaggtgtggaccaatccggagttcaccgtaggtcaggacaaggacctctgtcccgccctggaacgaatctccgagaagttccctcacgttcggcacgtgaccaactacctgacgtatcgccatcgtcggaactcgatcctgggtggtgggtatgacccggacgacctggacgaagacggcatgcctgttaaggggtacatggcttatcagcgcgaagacggtcggattgcaactccggcagacagttgtggtgctggtaccagccggttcaaacacaagcaggtggccaacattcctcgtgtgacctcgctgtacggggtaccgatgcgaaacctgttcggcgtggacaccaacaagtgttggcagattggctacgactttgactccctggaagcgaagatcgaagcccactactgcctgagcacggcaatgcgtctcagccctgctgcggcacagaagctcaagatcaagtttgggtccaacttcgccaagtaccgggaagcatgcatccaggcagcgcaagagtatgcggtagcgcttgtggctgagaagcccaacgatattcacacggtgacggcggcgaagatttccaccatcatcggaggagacttcagtcgtaccaacgccaagtcggtcaagtatggctgctcctacggggctcaggtggcccgtgtagcgaagatcgtcggctgctctatgcaggaggcccaggccatcttcgacgccttctgggaggctgctagcccccttgcgctgctgaagacggttctcaccgacttctggaaggagaaggggaacaagaagttcatcgttgggatcgatggccgccagattcctacccgttcggagcatgctctggtcaacagcctgttccaatcggcaggtgttatctgcgccaaggtggcgatgatcatgcacgaccagaagctgatggctgaaggtctgctggtagacttctggaaggacgactggaagaacaagtcgtactgccagcagctcatcgcttaccacgatgagagccagttggaagtgaccaaggatttggtcaagttcaagatgttctccaaggaagccttgggctggcaagagatgcagcacgaggacccagaggagcagaagaagcttcagaagaaggaagacgctcgatgcaaggccctggtccagcagtggaaggacgagatggaagagtcctcgggtcaaatctggagcgacatcggagagtccccgaagggcggttggttcgtaggctacagtcgggcaggggagacggctatcgaggctgtcaaagctgctggtgagcacttcaagctacgagtagacctgtccgcagggtacatgttgggaaccacgtggggcacctgccactaaggtgcctggaggaaatatgagcaagaaaggtaataccgaaccgacagggatggcgatcctggattacgtgaacatgcgtcaccaggaattggaagacttcctcctgtactgggtagagaaccatgccaaggggaagaactttcctttggagatgcccaacgacgcagagtggtttgagcatgagctggcctacctgacggtggaaggtatccgagaggcttgacattgcctctggattgtgcttcaataggctcctcgctgcaacaatgcgcggggagctagcaacctgaagtatgtgagtttttgataaaagtccttgactttcaatagcttatatgcttcaatagcgttccaaatgaggaggacatcatgtctattcaagtagaggagaccaccgaatatgtggtctgcaacaagtacagcctgaccagccggtcctacgccttcagcctccgggaagacgcccggaagatgaaagctcaactgggtggcaagcagttagggtggatcatcgagcgaattactcgcaagattgtcaccgaagaagttcgctaacaagcgacaaaccccccgattaggggcaactaccgcccgatagggtaattgataggagaagtaaaacatggcactgcgtcccaaaagcactggcaacaccggcaccccgcgtgagttcgtcaacctccccgagccgaccccgggtaaccacgaagcccgcgtctcgctgatcgtctacctgggcgagcaaaaccgggaagacttcgttgatgagaacggtgagagcaaagctcagaagcctgtggatcaggtggcagtattcgccgacctggtggaagaagtagtggactacggtggtgacatcggtgagcaacagtaccgcctgatgctgaacaagtccttccgtggtgaagtgagtggtatcaccctccaggcgaccccgccgcgtgacggcgaaggccgtatcgtcgaaggtggcatctggacctaccacccgaacagcccgctgaccaagctggcgaaagcaatgcaaccgggtgcagcaaccgcgatcctggacggtaccgacctggatatcgagccgctgctcaaccagccgttcatgtgcaccgtgaacgtcaagaagaccccggcgaagaacgacaagaaggacaaagacggcaacccgctcgtctataccaacgtcagcttcggtggcgcgacccaggtcccggccaagatgatgcgtgcaggtgtggctgagcttcgtcagaagccgctcctgatcgacttcgacaacgtgactatcgagaccgcccgcctgctccgccgcgatgtgattcgcaagattcagcaggctaacaacctggctggcacccgcatggaagccgttctccgtgaactggccaaggaacgcggcgacaaggcaccggaagcccaagaagcccccgcaccgcgccccgtagcaacccagcagagcgctcccccggctcagggtcctgcttcggacgtggacagcttcgacgacgatattccgttctaagacggaaccctcagggcccttcggggccctttcttttactccaaaggaggagatgagaatggacgattacgtggtgatcaagtgccgcgttaacactggtttcgcaggcggtgttcatgaagatgaagagcacatgccacgagacgagtgggaagagatgtcagagaaagagagggagcggttcctggaggggttcgcccaggacatggtaagcaactacattgatgcccacgcctgggtggaggaagagtaaatggcacagagcaacaccctggtcctgaatgacatgcacaacgtctacgtcctgcgactgccgagcgtctactttggcaaggacatcccggaaaccatgaaagaggacttcaagcactggaaagggcagctccatgccattgcccagggcacccagaattcgctgatgcttcccagcaccactgatccggagtcccgccaacccttgttcgacttccaaatcctgccacggaagactgaacaggctgccccaagcaccatcactattcaaaactgaaggagagagacatggaaaactacaacgacgagcgtgaaggtcaaatgaccgagaaggaactgttcgaccgcctggtgactctgcaccgtgaaaagctgaccaacgcagacgaccgttcgcagctcaagaaggatgccaaggagcacggcctggacaaggaccgtatcaagctgatcgacaaggcagcagcccacgacgcgaagcgcgacttcgaggagaaagattatgagttctcccagcttcgtcaggtttacgaggaactctcggaggacgcataatgtcccagccggcaaacacaattgccgtaatcgacggtgacgagtgggcctttaaggcctgctctgccgcagaggggcgtgctatcatagcgaagcacatccccagtggcagggagaaggaattcaaccatcgcactgaattccgagacttcctgaagacccagcacggtgggaagttcactgaggatcagttcgaaattcgggatgtacagtaccctgagcccatcgagaacgtcctgttcaccctcaagcaaatgattgtcggggtgtgtgctgaggtgaatgcctcgggctaccaggttctgatttcgggcccggacaacttccgactcgatatcgaccttcccaagcgctaccgtacccctccaaacaagcgagcgccgaacggcactgagaaggcgggacgctacaaagagtcccgaggggattccctccgtccggtacacctgagcgacgccaagaagtacctgatcaaaaagcacggggcactgaccacttaccgctgcgaggccgacgatgctctggcaacccgagggtacgccgggcgtattgccgagctgaagggtgctgctcagtggatcatcccctgcacacaggacaaggatgcgatgggtgtggagagtcgtctctacaaccccaacaagcctggcctgggcatcatggataacagggggtttggccagctcgtcgagatgggtaaggatatcaaggggcatggtcggatgtggctgtacttccagattctcctgggcgacagtacggacaactacaaccctcgtgacattctggagtgggccacctaccaggccggaggaactcctaaacccttcggagagaagaaggtctactctgtcctgaaggactgccaggacgaccgggatgcctggaaggcaatgtacgatcaatacaagctctggtatccggaggaagtggagtacgtgagctggaccgacgaggttatgcgaaaggacgccattgacatcatgcagatgtacgtggactgcgcccacatgcagcgttgggaaaacgaccgaatcaatgtccggcagacgctggagaaaatgggagtgatagaatgcagcaagtaagccttacagattggctggaagagttggacctggttctcgaaagtcgcggcctgccgtcagcccatgcgtacttcctggaaggcctgtacggggactactacgaccaaggcctgactcccgaggaggcagtcgaagaggagttcggctgatggagacggtcaccgagaaaggcaagttgtgggggtggttccctcacatgtacttcgttcgggcgggtatcatctgcgtgatccaactaggacccctgaagctgtccaaggtgggggctatctacggcatgggcctgttcaaccggctgttgttccagtggggtgggagatgagtgttcgtcgccgcccctgggaagagcttccagaggtttggaagactgaggcttcattcctgtcctggctgcgaggaggtatccgtcgcgccatgtggatgaggcacccggtcaagctagagttcatcaagaacaactctgtggagatggtgaacaccaacccacgaagcatgaagcggttcccaaccgtaaaaggcgcccagtgctccaaatgtggggaggtgaagcgtgcagcggacatggaagtcgatcaccggacaggggagttcagccttcgatctattgaggacctacaaaggttcatcgaaggcgtggtgctggtaggtatggacgacctggcatggctttgtaagccgtgccatgaaatcaagactcacatggagcggcaaggtttccatacctggggagaagcccaagctgacaaggaagccatcgccattggcaagaaaggcgtgagtgttgtcaaggcatggctgaaagagcgaggggtagagcctggcaccacaacagctaagcgtcgggatcaaatcttcgctatcctgaaggaggagtacaagtgacccaacgatgcatgttccggcaggatgattcctgccactggtacctggtcccggaagcagagtgcaggcggttcgatgagctgtgtgccctgatcaccggagaattagagccggactcggaagagtggtttgacgccatctgcgagttcgacaacagctatggccacctacgttgtggtcacccgtccaattacgtcatcacggcgcactaaggagatttcatgaaaccgtggcacaataccgctctagaactggcagcagccgggaagtcctggcgtcagattgccgtggagctgggcatggccaagtccactgtgagcgacttcctacgaactcagaagatcaacgagaacaagccgatgcccaaagtgctgatcctcgacatcgagacggctccggctatcggctattactggagccgctggaagactacggtgggccagaaccaggtgttgcaagagggttatttgctcaccttctcggccaagtggctgggcagcgatgatatcctggagtgcaagcttccggatttcgacctctacaacaccgagccgaagaatgaccgagagcttctcaaggtcctggcaggcctgctggacgaggcagacttcgtggtggcgcacaatggccgcaagttcgacctgccgacgatcaatgctcacctggtgaagcacgatatcttgcctcccagcccgtacaagatcatcgacacgtgcgacattgccaagaaggtgttcaagttcccgagtaactctctgaagtccctggcgattttcctgaagtgtcagcacgataagcttgatactggcggtttcgagctgtgggcgagagtcatggatggagaccccgaggcatgggaccacatgatggagtacaacgtcttcgacgtgattgtcctggaggaggtttacttgaagctgcgtgcgtggtataatacccacccgtcgctctctgcgttgatccctcagaaggtcactccgcattgccctgtgtgctgctcggacgacttgcgtccaacgggcaaactgtactacaccgcagtgtcggccttcgaggttctccgctgccacagttgtgggaagcactcccgcactcgtcagaatgtcttggaccgggaacacctggtagtcggcatctgactcaaagcccaccttcgggtgggctattttatatctacaaggagaattcacgcatgatcatgagcgatctgctcgacgccccagagaagcccgaaaccaccgagatggaagtgtccatcgatcaggagctgggggctgacctgctgatgtggttggaaaagaactaccccgacaccccgatgatcactgtgtatgtcactctgctggctgccacgcagatgattgccgaaactatgaaggtggcctccacctccctggacgaaggagtcaagctgtgaaactgggaccctctgtaatgatcactgccagcgagtatgtcgcttccaaagaagcggcagagatgttcaaaaccattggaagcccgtctggatgggtaaaccctgtagcccctaccgaagaggagggggaacacacgggaagttcttccagctactaccaggtagaggtccgaaaccccacctctggcggggagccctacataggggagtgcaacgattttatcgaagcactgggcatgaccttcgccgaagcgaacgtgttcaaggcaatctggcgaaaagcagccgagcgcaccttgggtaagaaaaagaagggcaacaacgctgtctatgacgccgagaagatggtattcttctctcagcgggagctgattcagacccgtgccaaagcagaaacgaagaaggagtaaccaatgaaagcgagcgtgatcgccaaaagcatttcctacccaggtacatcacagttcccggtaacaatcaccaccttcgagctggagtatccccggttcatccacgccgagctgatgacgcaccacgctctcttcaagaactgtgcctccagtcgggctatcccaaccaagaagctcattgagcaggtgcggaataacccagctatgccagtccattggggtgctaaccaggccggcatgcaagctcacaaggagctgtcgaagcctcttcaggtggcagccaagtatctctggatcaaagctgccaaggccgccgctgggatggccctggctatgcacaaggttgggctgcacaagcagattgtcaaccgggtccttgaacctttccagatgatgaagacggtagtgaccgctaccgagtgggagaacttctactggctccgtgatcacgaagacgcccagccggagttccagcacctggctcgaatgatgaaggaggccactgccaaggtggcccctgaattgctggtccctggtcaatggcacgttccctatgtgaaaacggagttcatcccgggcctgggccggcaatacttcgatgagaacggggaggtcatctctgtagagcaagcgttgaagctttctgcaagctgctgtgctcagaccagctaccgtgccactgacaagagccaggacaaggccgaagttatcttcgacaagctgatcaatagcgagccagtccacgccagtcctaccgagcaccaggccacccccatgcatatagcaggtggctgggagaagggtgtgacccaccaggaccgtgatggttgttactggtcctccggcctaaaaggttggattcaacatcgtcaactaattccgaacaattgcaagaaggggtaaactgtgagtcaaggtaaggtcgagttttcgctgtccgtgtcggacctgcggctggtaactggtttcaaagaggcgttcgccgcctaccaggcaggtaaccccaaggtcttggcagccctgctgtaccgcaacggcatggacaccacacagccctacgaagtggttcaccgggaacaccggaacctccgtgggcaacatatctccggcgaacgtttcgaaggctatgagcgactggacgagagctggatcaagaagggggcaccgagcgaggaggcaatcatcgcctctgccaaggacggtagcctccgtgatgagctgatccatatgggtcggcgactaaaccctgcacaggctatggtggatttcctgaatgagtgagagtgttcagccgtataacggcattctgattgattattccctggaccggacgatcccggaacaaggattggcgatgctcacctcggacggcttctacaagaaggaacacgagacatcgcctcaacaaacgctgtcacgagcagcggtgagctattgcttcggtgactacgattttgctcagcggatgtatggctatttcagccggcagtgggcagtgcctgcaagcccggtacaaaccaacgccctggacatcgagtggcccaatttcaccgaagagcagtttgacgaagcaggggactggcttcaagaaaacatcgataccaccgggatgcccatcagttgcttcctatcgatgatcgcggacagccgtaaaggcctcacaacggcctctggtgaagcgaaagagttgagcatggctggtggtggggtaggcgtctacgcaggcatcagggccccggatgagctgtctacgggcgtcattgagcacgctggggactacgatgtcatgtgccgggcttaccgtcagacccgtactcgtcgtggcagcatggccatgtacttggacgtggctcaccccgagttccctgtgttcctccaaatgcggaacccggtaggcggtgacccgaagctgaagcgcttcaacctgaacaacggtgctaacatcccggacgccttcatggaggcggtcatcaagggtgaggattgggagttcgttgatcccaaacacggtaagactggacgtaaggttccggcacgtgagctatgggaagagatgcttcaggttcgtaaggacacgggcgagccgttcatgttgttcgtggacacggtgaaccgtaacctaccggaatgcatcactcatccgctgtaccgggtacgacagagcaacctgtgctccgaaatcaccctgtacaccagcttcaagcgtactgcggtgtgctgcctgtcgagtgttaacctgggcacctacgatgagtggaaggacgaccccctgtttatcgcagacatggttcggttcctggacaacgtgctggagttcttcatccgcctggcacctccgagcatgcaccgggccgtacactccgcctccaaggagcgtgcaatcggcttgggaaccatgggcttccatactctgctacaacagcgtatgatcccgttcgaatctggtggcatgggtggcatgcagcagctcaactaccaggtttacaagcaaatcaaggagcaggccgtacaggccagcttggagctgggacgctcccgtggggaggctccggactgccagggaagcgggcgtcggaatagccatttgctggcgattgctccgaatgccaacagctccagcctggtcaacgtatctccgtccactgaaccctgggcaggcaactgcttcaacgctcaaggccgggcggggagcttcctgatcaaaaacgaatacctccggcgagagctggaaaaagtcggcctggacaccaaggaaacctggcgttcgatcaacgatgctgaaggctcttgccagcacatcgaaggtttgagcgatgaggtgaaagcggtgttcaagacgatccgggagattagcccaatgtggttgattgaggcagcagcagggcgtcaacccttcatctgtcagtctcagtcggtcaacttgtacgttcacccggacatcacgctgcaagagatgtcggacatccacatctgtgcgtggcacaaggggctgaagagcctctactactgccgctccaaggcggcgaagagcatgaaggttggtaccgggggcgctgagcctctgaatgccctcccagtgcgatacacaatctccctggacgaggacacttgcctgtcctgccaagggtaaggagcacacatggcgttaaccgtggaaaactgtctggcgttgcagtacaagtacgtcaacttcagttatccgatcacgatgaacgaagacatgatgttcgtggtgccaattccaccatacaacacctacttcctcatcgacgcaatggaccattcctccactcacggaggttcccaactcaagctgctgattgcgggctggttcctgttcccgcccaccgccagctatgagtggaacatcatgggcgttgcggaggctgaaaaaaacgagctgttcatcccccatgaggtggaagaggcagacatcatcctcaacccgatgcaacccccgccagaaggccagatgtggccgcatgaaatctggactgggcagtaaaacagaggggccttcgggccccttctttgaaaggagagattgtgagcgtatttgttgaaagcaccagttaccgtccctttgtttacccttgggcagtcgaggcagctcgggtccatgccatcgatatgcattgggatgttcaccaggcagacctgacagacgacaagcagcagtatttcagcacctcagggctcgggaccaaccaggttccccacgagaaccacaagtggctgctggacaaaaccctgtccatgttcaccgagatggaccggacagtcggcgagggctacaccaagctcctcccgtacatcaagaacaatgagattcgaaactggctcattactgccgcctcccgtgaggtggttcaccagcgagcttatgccctggcagccgaggagttcgggttcaccgatggcgattggaaagcttttgcctcctacaaggagatgcgagacaaactggaggtgatgggagagaatcggatagacgcaagctggtccgagcccctccaggccgcttgcatcctggcccaacttctgaccggcgaaggtgtaggcctgttcggtgcgttcactgtgctgctgaacatgaagcgttgcggcaagctgatcgggttcaacgacatcaaccagtggagcctggcggatgagaccgaccacgtggagaagaatatccgcgtcctgaaagccatgcgtaaggaccttaccccggaagagaatgcgatcctggaccaggaaatccgatacctgatcgaagactatcgggaagccgaggtcaagtatctggtcctggctttcgagaagggccctcagcatgacctgaccttcgagcagactgtcgagtacatcgactacctgtgccgcctgaggctcttcgaatgcgagcttctcaaggagcaccaggtgggtgagaacccgttgccctggatggaatggatgatcaacgccgcccgacacgacaacttcttcgagaagaaggtgacggactatagccactccaagctgagcggtgatgtggattactccaagtacaatttcatgttgactagccgagctggttgacctatcatagcccccatgagctgaagagccgtgggggctttttcgtacctggaggattttatggcatctcttttcattcttcgaatcgaaaccgtgtgtggcaagggtatgtatgccgacgcactgagcagcaaggtgcaatccaagaccctggagggcctgggataccctcggtggcaggctactggcctctatatcgatctttgcatgtgcttagacaaggagaaggaacttcatccagtccccgaggaagacatccccgggtgggaagaccttgccaagaatgaaaaagagatgctcacttactatttcggcttcagttcctgggagcaagcacgagagtgggtaggcttgcgtgctttcaacgagatgggtatgctaggggccaacctttgcatttacgagatgaaagaggaagatgtcctgctgggagggaaacaggccgccttcaaaatggccaacgctctccgggtgttgaagatgcccattaacaagggcatgcaagatttgatatgggaggagattgaagggtatgacgactaagctgctacgtttccaggcagagagccctaaaggggagaagatcacattttccttgaactggtggtcagacgggagtacaatctggtatcgtatccaggcagaccggggagcttcccgggcttacaccgacatcccttgccagcaagaggccatgaaggaccttatggaggctcgggaggtgtgggtacgggaagggttcctagacaagttcacctcatttacaacgaaaggaggagttggattccatgagtaaagaaatcgaagcgtttgacgtggcaggccgcctactgcatgttggcgaccaggtggctatcgccagcaccgcagggaaggctactgagatggtagtcaccactgtggaagctgtccgggcgaagacggtaatcctgaaacatccgactgcctggggtgctcaaacctctcggcgtcactcggctgtgtgcaagattcccgaactggctgggaaggaggtgtaaagtgaacaagaccatacgtgctcagctcaacaaccactacgaccgtcaggggctgacgggcaatcatcgccgtctggcaatgaaggctgacctccggctggtcagggagcggactgaccatgacatggcggagtggttgcagacgggagaaggtatgttcgtgggtttgaagagcgcctttgtgtggagtaacacccgggaaggctatgacttttggctggataagaacggccaaaactgttgacaggttgtatggggccgggtaaactggccctatttcaaccgggaggtaaagatgaacgatcaaaactacgattttcatgcagagggaaatttccccgcccattgcgacgaacgggctgaacgcttcttctctcgggttttcgtagggaagagcgtcaggggtgcggataagtacggctacacctacagttggaactcccgccacgccgaccttcaacctacttccacccttcaacagcgaggggcccactcctgctccttctgtggtcgttctgctctccctatccagaacagcggggatcggtttgcagggtacgactactccgtcacggggtacacctgcatctgctccggcgccatggacgagcttgactggattgttcaggcccagaggatgaagaaacgtcaccaggaggaagtggaggagatgttgcttcaacgtccggtacctccaaaagatgtccgccaggaactgacaaaaaatcgtctgatgaggttgctttctgacgtggagaatagtaaccttgtctccgcaatgaggctcctggagataacctccaaccgcccctcagtatggaacgaaagctatgaacacttgggcagctaaacgccaggaagagatggtatcctgcgggtactctttcaaaaagcacgaagacgggtattgggagtgccgggacgaagagggcaccctcatcgagactcaccgccaactgggcaaactgatttcactgatggccagctccctgggcatcaattaggaggattccatgcaagacctgtatagccaacaccgcgccgctgtcaagaacctcatccgagaggggcgtaagctcaaggcgacctacgtcatgaccatctacatggagggcttcagacctaagcttgaagaccctgaagactttgaggtggcgaatctcactctgggtaaaacctatgatgttatcacggaagggctgtacaaggacaattccttccttgtggtggatgataagggatgggatcacctgttctctctggatatcctgcccgaagaagggggaagtacccggttcgatgtgttcgatcacttcgtgttcgacgtggagggtcccctctgatgtacgagattcagttgatcaatgacctcaacggttgcacggctactttgcaggttgccgatgaagaggcagctctggatttgatggaggagatggagtatgcctggacccgctatggcagtgattggatgccgtcttggttagggtttaatccgaaactctcttgacaacaccggagggctcttatacactgagccctcaaccacctttggaggatttatgaacactgctcaaaccatcgcagacatcctgattcacctcgctgaccgtctgtacactcagaagggtcgatgcctcatcgacgggcgctgcaactatgtagatggccagggaaatcactgtgctgttgggcacctcctaagctcccagtcgtgggagttcgcttccaagtgccacggcggcgtgccatccctggagaacgactgggcgcggcgtaaagatggaagtgtggagactctctatgacgagaagttcttcatcgcagacatcggtgttcgccgccgtctgttggactctttgcagttctaccatgatgagccgtctatgtactggacagtggctaaaagcccgtcattctcaaaggtaagcctcctgttgtctatggtggatttcctgaacactcaaggcctggactttgttgagcgcccccaatctagtgttaagggcttctggtcggaagctaaaggaattcttcgcaatcgggggtaccacgtatgaacaaggctctccttctgaaagaccagttggcagcagccctacgatgtgaagaccacaccctgcaaggtgttgtcagttctatcgtgttcggccctacccaggggcttgatcataacggtattgcgatccgtgggccggggcttctaagtgatcaccgggaactggtacagcgagccgacagggtatggatgaacatcgcctaccgtcgagcaggtttgctagtcaacatgaatggctttacccggtctgtggtagatgtgtttattctcaaagacaggtatcacgggctgacagggttgaggtccgtgggtgtgggtgagggatgggcaaatgccctggccatcgactgtgccctgctgaagaagcagttcgaagttattgtcgaaatcccttaccagtacgaggggtgggcaaccgacctggtacgggcaggtgagattcctgaaggtgtgaccatcatgtcctcggggggtgtagatatttgaggggctggggatatttgctctagatatttgggtggccccctatttcgagctagatatttgaatgggcctcccagcctcgctatcacattttaagccggcccctgactcacggcctaggttaggggagaaatcgtctcctaggcccctcagaggagcttacaagtgcatatcaacatcacgcttacagtcggtcctgagattcgttgtaagaagtgcgactcccccacccctgcccgggatatcgtagaaggcctctgcccttcctgccggacactcaaggcctgggaggcgcttgggcaggctgctcaagagctgtgggcttccactttcaagagcgtcaagatcgattccgttcggcttgagcaaggtacctgacagattttcacagccgggcgtaaggtactcgacagattttcaccgagcgcccaaggtactcgacagatttttacagagacaggtatcaaaagaactgtcaagtttccctccccaggcggcccgacccctcggcctcttgtagcacgtcaactccccgctgtagcacgtcacttccccggtaagtagctccctatctatccctccctcaccgaaactacctttcacatgcaatcgccatgccaaccttgaaaagcgcgcaggggcggtgtttgtctccggcgcccggcccctccggcctgctttcccgcatgcctacagaatgccaggatgagcctggagtgtcaagcctttggccaggatttttcatcgccgacctggcatgctctttgctacgcttgcgcgttcctctacctggcgttgccagagaaatttcttaaaaagggggttgacttctaaccgttccaccgtagaatgaccctcaagcaaggcaaacaacctgtaggaaggtaaccatgcaaaaagctctctgcaatcaacgtgacctgtacgctgcctataaccgtggcgagtatgaccgcgtggccgtagacctgaatcggtacttccccattgagcgggataatcagtgggaagatggagatgcgaacctgcgtcgtcgcacctatctggtgaagcactcgaagggcgtggccaggtggcacactctctatcgtaatggtcaggttcacggcgtcggcgttatcttcgacgtcaagccggacgaacccttccgaactgcctgaggagagacaagatgtctgtcaaaataggggatatcgtagccatccggggcgaccttcggaaaaagctcgacggaacgtgccaatacacgccagaacagttggtaggtggtaagttcctcaagcataccggcacgggagaaatatggactggccgagtgagtaagatacaaggtgatatggccaaggtgggaggggcttggcgtgggatcgaattctatgtgccggttgacgaaataaacgcttgacaacctgattcactggcagcacaatagcacccccaaaccccgacagaggtaacacacgatgcaaattcatttctcctcccgtaccgcagcccgtgctttcgtgaagggctcttccttgcctcgccaggtaaccgataacggcgcggaagcttcccgccgctggggagtcaagctgaatatctcccccagcgtccgagtgctgggctgcgaatacctcgcctttggcaaggcgggcaatacggtgcctgtctacgtcaagtaacagcagagtgcttttagggttgcccctggacgccgggggcagcttgcctaaatccactccgtaggagataacacgatgaacactgttcaaaaaaccgtcctggcttttgttctgaccactcccctgtccctggctgctggcgccatgatcggcaaggccgttgccctccctcccgcactgaaagctcaggcggttagcctggagatggcgcatgccaaggacctggcagacaactacgttcccaaaatgaacatcatccatactgctacaggtgctatcgagctaggccaggtgtacggtgaccgcctgacgggtgaagtcaaaatgatcgttaagggcaaagtgatggccagtacgcacattaacggtcgcagcgttcagcaagccctggaggaggcagcaggtggcactatcgaagatcgcgtgctgaataaggatgtcactttccgaatcaccatggatcgcctgtaccagtccgaaaacttcccgcagttcacagtagtgatgctgaactcctctgtctatggcaaagacggtgacagcctaaccgcactggctgcccgcctggaaaaacagcgcctggccacggtgaagttgttcgaagaaacccgaatcctgaaataaagtgttgacacggcatctcgtgtctgtagaataggcatcacagagggggacggtccccctcctcctaaaaggatatcagcatgaccactctcgaccctaaagaactggcacgtcaaggcatgatcaaggaagctgttcaagctttcaaagatatgggcgtagattctccctggaatgccgagaatgtggcaacattccgaaactacgatgtcaccctgggcgaggtggacttgtccgaagaggagttcgtggaagagttggattccatccacgaaggggttaagatagccaacatctctttctctgccggccaagtgctgctaaaaatggaccccatagctttccgttgcgcatgcggggagtatgagtctcaattgaccgaggagttggaggaggcgctgcgagacgaagacgacgattgtatcgaattcttcatcgaccccatcgattgggaagcggttgaagaagaggaagaataagggttgacaaggggccaggaaactcataaactggccccaacaccaacgcactgagggtaacacaacatggtcaagttcgaagagattgcacaacgtttcaagaattcccaacgccgctgggacaagccaggcgtcatggctgccatgcaagaggctgtcaataacgctcccgtcaaggtagtggtagagtccaccagcaaggcgctcaagcccgacacccctaccgttcggatcatcgtccgggagtggatcaaagctcggctcggcgaggagttcacggtgtacgatatcatcccctacgtccaccacctggccacccctagcgatgtgaacaacgccctcaagcactggaaactgcaaggcgtgcaaatcccgaccattcgccagcagcagagggaagcggggaaagctggccgcccgatcaatgtgtatcgttgcgatgagttcgcagcctaacctttcactctgaggagatatatcatgcgtactgacaaatccggcgcccgttccgaacgtaaagaagccatcaaggcgagccgtgagcttcgtaacctgcgaaagaacaagcgtaaccagtgggtcagcaaggactaacctggcgcctggggcgccttccctaaaccctggagaatggccagggtttacgaaagatgctctagatgataccctgcaatcccacatttgaggtttaatcatggtcattgaatgtcatcctggacccgtagagtattgcttttccctggcgctgtgcctggctaaggcgggggttaaagtgaaactgttccgaaccggtaaagagtggggagtgattccgtgccgagacgtttaagagccattccgacctgggtatctgggggagatgaagaagacaccccgcgcaagcctgtcctttccgtgatagaccgggcttgccctattcagcggaagttaaatgccctggaccgagattgcgaggagttacggcgcaagcaagataccctagagcctgccacttttgaccaactggccaatagcctggaagagcgccggcaagccttgtggaaggccttcgaatccaagtatggcgcagagcctgagggggacagccacgacactatcaaggctttggccgatgccagtatccagcctgcgcagcatgtggacatcggggcactgctgttgctaggactggtggcgttactctttgccgcgtggttgttcaaataaaagatcaaaaagggcttgacgtgcgcaacggatggccctagtatctctctcagaaacacaaacctttacttacaaggtagatcgaaacatgaataccaatgcaaaccccgcgcaaacccttactcccgccgacgctttggaagcggtggaacttctgatgatcctgggaatcgaggcgtaccaatccggtgcatggttgaatgaaagtgattcaactgttcaggttactgacagcgctattgcgttgtggagcagcactcttaaccgctacaagctgctggacctggcacggacgtttgctgaagaagccagcttgttagaacttcaaatcaaagcccgggaggtttgctaatgatcagtctcgttctcactctctgcactgccctggcatgtgatgattatgtgatcgctcaagacagcgatgctgacatcatcaatcataccctgtacgttgaatcagaagagttaggcgatgcctgggtggcccctaacgccaatgcccgcattggccgctacctggcacggttcaacatctccactcccccggctatggtagtggactacgactacactgtggagggtaactgaaatgcattggaacattctcgacgatgtacgcgccagcctggcaatggttttcctgttcgaagcggtccatgatgtggctgcctggaccctgctaggccataagcatggctttgccattgaagacgtggccgccctgtccgccgagttctacctacctctgacggaagtattccaagccctggaggaagcatctggcgatgtggaagaggtaagggaaaccctgcaacaggccgccgcaagtcgattagtcgatgactccctggactactacagtcgataacccaagccccgctcctgcggggcttttgtttgcctgaaataaagtgttgacactataggcccttcctgtagaatggccgccatacacaaggaaaatgttccacaacatcatctggagataatcatgcgttcgatcaaatccctcgcacgagaagcctacaaaaaccgctatgcgtttgcacgtgtaaccgttgcccgtgatggaaatatgctcggacattgggatgaggagggttttgacccggtgaagctggggaacatccacgattgttccaccacggtgaatccgagaaagactggcgtttgcttccgaaaccgtgactttctggtattcactttcgggatggaggtccttaaataaccactcgcaaatctcctttaccagcccggctgtgccgggcttcacagtaaaaccgcaggcagagcagaatccaggggcttgacaccagcgatagccccggtagaatagccatcaagcaagacaaactcacctggagaaagcaaaatgactggtagcaaccctaacatcgacccgaacactgtggccctgttcactgagatacgtttctacatggcgcgcgccttctttgcccatgcattcgcagatcaagctgaagacgccggacagcccttgcaaggtgagattctcgaccaattgccgcagggttggagcgcggattgggcacccttccatgcggcggacactcttattgcacaactggtcacaggcgtgaaggctgggtaccgttctgaaaaagttcagaaagccacccctgtagagatcatcggtgccctgttcaaggcttgcaagagtcgtcatggtgggcgcgcctatgaccgtgaagcgaccgccgagaacttcgggcattacctggcaatgggcgccatgggaacgggggtaggtatggagtgcttcggcccggacgtggcaaagtatttcgaagggctgccctatgtagagttcggctcgcacagcctgagcaaagattatttctgaggagaacactgtggcaactcacaaggcaattcgtgacaccctgtctgctgtaacctccctggcatttgccgaggttgaacgcctggcgcgggaagtgttccgggaagaccccaactgtatgaatttctgcatgtctatgggtagtgcatccttctatcgggagtggatcgattgtaacgatccggacggggattggcccatgaacgggtacctgagcgccgaggaagtttatgaaatgtcaggcagccaggccgccaaacacctcgacagcctcctgacagagttcggggaggcgcttcgtctaactggccaccctctgaagttgacccggatgactgaagacagtatccttcgacaaacggactggtaaccacctacatcgggagtctccctcaatgaagcaagtgtcccccaaattcatcattcacgattcgcacctctaccgtgctgccatcctgcccaaggtggaaaaggactctttgggcaactggtacactgcccgatatgtctggactaaggcagggattcctcttgccaggttgatcgcgggagaagatcaaaaccccctggaaagcttcctgctggcagagggcgctgttatggaccttggccaggccgaggagacgactgtggagcctgctactccctggattgtctttgtaggtgatgatccggtagcagcctgcactaccaatgccagggcgcatctccacatcgcggagcaatggctaaacggaaactctaccgccaaggtgatgcattgggatgaagtcaatccggatgtgctggcgcctatcctgcgtaaactggctaatcgcggcatctacctggcgacggacggtcagaacatcgtgaccgtataaagttgacaagacccttttgggtttgtaagatgcgtgtcaaagggaaggtataaagccttcccgcttcaggaaggtgaacaggaatgaacatcattgaccggacccaaggccacgagagtcccaatcactgctatatcgtcactggcagcattgggccggagttcgaaccccttcttttcacgtctaagagtcttgctgttcaatacgccaagcaaatcatcaagcacggaaaagcgcacgacgttttcccaccctttacgcctgttatcgagacccgccacaaggtggatatgcaccggttcaccgtccacgacaaaatccctgaataaaagcttgacttccctcccgcttcccgtagaataggcttcaaagggcaaggggccctctttcataaaggtgacacaaatgaaaaatatcgaactgaacatcggcggcaaagacttcactttcaaggtggaggtggtgagagatgatgagcatggggccccttgggaagagcaagatgggcatggccctgtaagtgattggacctgtcgagataagcgcccgggcgagttagtcttgaacagtaacggagccaggaagcgtttctatgacttctccgaggcctgccggattgcccttcgggaaggatgggacgctcacccttacaacctctttggcgagcaatccaaacgccagcaagctgcaaaggccgcccgtgccgacttcgaaaatcttcgtgcatggtgccaggatgaatggtattgggtcggggttattgtcaccctgctggacgaagaggggaataaaacggacatcatcgactctgtgtgggggctggccagtaacgacgaagacggcatagcccatgaggctggaatcatcgccgatgacctggcaagaggctatggcgtccgctggggcgagacagaaaaaactacttacgaattcttctaaaatcgcttgacagcttgggccattcgcgtagaatggccctcaagcaagacaaaccaccaacaggcaaaacccaaggaactaaatcatgactactgaaaaccttacctctcaagagatcgaaacttctgttgacgcattcctgaagtcaatcgacgttaccctggccaccgtgcctcgtggcgagcgtaaggctgaagactgggtgcatgacctgtggagtgtaagcttcatccgtggcgatggccgccgtggcgttctcgacactgaattccgcactggcgtgggtcatcgcagaactacagttcccatgccgtttgaaatacgtcgtctggctccgaacatcctggcacgggtggagtgggaaaaacgttacctcaagcctgtagctcctaaggccgcctgtatcctgtccagccttatccttgactgcgatgtcggtagttccaccttcgaagagttctgcggcgacttcggttatgacacagatagccggaaggccttggatacttacctggcgtgtcaagagactacgaacaagcttcgccagttcttctctcaggaagagatcgaaactctccgtagtctggtagagcattactgatgcttcgcgtgtgctacaagtgtctacatgttgggtatcctgttagaaccctaagccggaaaaccaaggtctggtacctaggctgccccctctgccgttctggagtcttcttttcctgaacccaagcccccaatccgggggctttcttttttcctaaagggcttgacctggccccctcttcctgtagaatgcgcatcaaagggaagcacaacgctccccagacaggagaccatacccatgagccaggtcaagattcaagagtacatcgtagccgagatcaaggttaaccattgtgctcatctgcgaaagggccaaaccatccaagcccgcgatgatcgtagcagtgaaaagtggattgcattcatggtggaacgtgggtatagtgcctctgaagccgctatcctgttcaaagatgcacatgatgtggcaatgctcgaactggcagcataactctcgaagtcaagcaaacaaaccccggagattcccatgaacaccttcgcatacgcccactacgtcgcccgcatggacaaggcctcgggttcgagccttccctactccaccctgttccgcattgcccttcgtaacgcctaccgcaagcctggcgtccgccaatatgattacactgccctcgccgaggatgtcaaaggccgcgaactggcccaaaagcgcacccgtgctgaaaaggctgtcgtgatggctgcggtaatgcgagggattcgcatgggcttcaccgtgagcgtgaaggacggcagctatggtgaatgggtggtgaaaaagtctaccgatatcaaggaaatctctgacagcctgcaatccacctgtgacgacgttatccgcttccgtaagggagacggcccggacaacgttgtcggctccctgtgggcaatctacggcaacagcgctggcgaagtgatcgcggattggtcggacaatgacaccatggctatggtgatggctcccgcagagcgcaagatggaaaaatacgctgagatggggatttaatgctttacggggcccggcaagggccccataatgcaccctgatcaggttgtaaggaacctttgtgcccttgcggaatacaagtgcccatcccagggacgccagataggaggcgaaaaatgaagagcaagtatggaaaaaacatcgctgcggaatataacctttcctgccgccttcgcaggattacttttgaaagcgccaggcgccaccctgacagccgcattgtgaagctagcagcatcctacgcttgtgctgcctatggccgaccttacaaggactgtattggtgcctacaaggccgccaagcggcgggagaaggcaatgcgaaaccccgccacatggaagctcagccgggaagctaagcgggccgtgcagtggctacaagctgccatgaacaaacgcaaataaggctgttgacagcctaggccattcctgtagaatggccatcaagcaaggggataagccccaagcactaggcaggaagacggcaatggtcactatcgctctgaatcacaaaaacatcctcgacaatgcttgggcattctatgcagccgacgtgatggtccgtatcgacgccatgcaggccgaggaagagcgccagatgcgtgagtgcatgggtaaccgcgacaactatgacatcgcggaaattcagaaggttattgcctacaatgaaagccacggatggactcgccgtgctaacatcgcccgcgctatcctggccgagcgcctggcagaacccttgactcactcggtagacatcgcctttgcagtggaggccgatatggaagagattcgccgagtagaggttcacaattccaaggctccgaccatgcggcagttgatcgaactgcgcgacaagtggatagccgaaggccgagtcgatttgcatgcgcagactgtggagcttatcgattggtgggctgatgcgatgttgacagaaaaagcttgactcctcttctccctgggggcattatgtctccaacgaaacggaacagcccccaagggagaaaaccgatgaacctgcaagcccaagcaaacgccctgttcaaagcagccgaagagttcaaagcctgcaaacgcaaccgtagcggctcgatcaatgagaacagcaagcatgcggtgaaaaagcgtctggtagccaagctgatggaagcgggcgaggacagcagcagcgcctgggcgatggctcatgacctgggccggaactacaactgatcccataggcccaccttgaggaggtaggaggtgggccatcttttaggctaaccctagagagggaaaggcaatgaagaacgttcaaatctgttgttcgaagtgtggagcaatcaacggcggtaagagcaaacacaatgttgtagtggctctgggtaagaagtggtgcgggcactgtgggtctaatctcgcaatcaaggaaagatcatgaacgccaccctggcacgcctacagaatgaacgatgtgccactcttcgcctgatgcttctgccggagcatcgtggataccagttcactggccacccttgggccgagcgaattcgcaatctccacgatgaagcccggtgcatccgcagccatcacaactaaccccttcccagcccggcatagccgggctttctctcataggaggaaccatgaaagttcagatcggtcagcataccctggaaatcacagccccatccgtaacaaccggctagctacagagtattgcagtgtgtccttgaacgctagacagctctacgggggtttcaacccttttgaagcctggggactgttcgaagacctggagaaagccctactcagcgtcgaagctcagtcggtagagtctgaggaggccttgcatggctggtaacgacctggggcattctccattcatcccctatgcctcagtgccaggacctatgtttgaattcgagtggttcgacgtagggaatgccgtcatagagctagagccaggatggctagtagggggtcgggtttggagtggacagcttgtttgtgctcacctgggttgaaagggaaccattcgccgagtggctgccctggacccctaatctcaggtcatagattctctattcggtgtgactcgattctctattcggtcgccataataatgaccctggggagggtcctacggaccgtcacgataacaggggaattatggccatgttaacagggcctataggcttcgtagaagccagtttagcttaggcaataccctaggatgggaaaggccttttcaaggccttatgcgcgcccccagggggcctatcggggagggagtgggcaagtgccccctccccgtgtctaagccttatcaactggactcttcgagtccattccaacaggcttctacgaagccatataatcaccagtcatatcaccaatcatgcgcagagcatccgggtaggatgatcaagccattggtccctcctctctgtcaagaattctgtaacaatcactaggtcacgatgtgacccattgtgtaacagtcagcagactgtcatccgggcaggggcacttgcccccttcctgccctcctaaactagctggcttcgacgaagccttcccatgccaccagcccgactatgtaacagcctggccatgaccatggcccattgtgtaacggcattgcatgccaggatcaccagacggcctcagccagcccaattgtgtaaccattccccatctcagcagcagattatccccagccaggaagcccataaccctccccattgcatcccaggtgctaagccctaggaatacgtcgattgtgtaacccatggccacccatgccctagtaggcctcttcgaggcgagctaatgccggtggctctctaccctcacgggaagagttccccctttattatggcgaccgaatagagaatgtccgattcatgcggcctgtaggccattacaatggccagtccggggaggattgcattacacaataggcttaccctcacccctggattgacaggcctcgcagaggctagccaggctcagacaggcagcttgagttacacaattcaccctcacatattgccccactccccatgccacacccctgacattcaaccccacgcccctgcctcagcagatacatttgcttcgacgaagcctggatatttccatatcatgacggcgcctcatggccacccctgggtcgtgttaaacaccccggctgtag

SEQ ID NO: 15 - DNA, 88834 bp, Myoviridae Nankokuvirus
  misc_feature (1)..(88834)
acgtgacccattgtgtaacagtcggcagactgtcattcgggcaggggcatttgcccccttcctgccctcctaaactagctggcttcgtcgaagccttcccatgccaccagcccattatgtaacagcctggccatggtcatggcccattgtgtaacggcattgcatgccaggatcaccaggcagcctcagctaggccaattgtgtaaccattcctcatcccagcagcagaatatccccagccaggaagcccatgcccctccccattgcatcctaggtgcccagccccaggaatacgtcgattgtgtaaccaatgaccacccatgccctagtaggcctcttcgaggcgagctaatgccggcgtctctctaccctcacgggaagagttccccctttattatggcgaccgaatagagaatgcccgattcgtgcggcctgtaggccattacaatggtcagcccggggaaggattgcattacacaataggcttaccctcacccctggattgacaggcctcttcgaggctagccaggctcagacaggcagcttgagttacacaattcaccctcacatattgccccactccccatgccacacccctgacattcaaccccatgccccagcttcagcagatacatttgcttcgacgaagcctggatatttccagatcatgacggcgcctcatggccaccctcgggtcttgttaaataccccggctgtagaaccggaatttgaaaacggatgcccctccccagtcacaccccccaggcccgttccccaggatgcccccagatatatttcccaggttggtgcccaggaagggtgccccatgtacccctgaaattttggcggggggtgggtttctgaattgaaaaggttgattgaaaaatgttgacaggcccctgccggggcttcacaatggccccatattcgctgctagagaggagacacccatggctttgtttatgtatgatgttgatcccggctccctgcctgtaggctgctacggggcttacctgaagactcccaaggacatctgtagtgccctgtgtgagctggctaactgggctaaggaaggatgtccccagcatcccgtgtttgaaagacagaaacgaatctgcaacaacgtggggaagtaccttcttacccatggcaactacactcccctggcgatggtgaactggaagctggaatacctaatgtcctgggctgggttttccagagggcatcccttccccttcgagctgggtggtaagcgggatgagaagggagagtattacgagaaccccaacaggttgcgtttcctggacatggtgactatgatgtccaagatgtattacaacgatgaagtaaaacgtctggaaggagggaagaatgatgtctagtaacgaacgttttgtacgggctgtggctagccgtagtccgaaggtgaaggaagggctggcgaggatggtcaagtggtacaaggaaggtatgcctggtgaccgcaccttttccaagtacacccggctatgctccaacatctttcttgagacaggtgttgagtatgccctggttgatctgttcacagcttacgggctgtccttcacctcctcgtaccccttcgagggtggtcagcggacagaggtccctgaggacatctacaagaaccctctccgggtcaagttcctactggatgttggtgctgtgttgaaggaggaaggatatgattgctgatctgacatatgctcaacgtgttgctgacctgaagtgggcctgggacaggactgataagggtctccaggaggtgctgagggagttcgtagcctggtacaaggccgggtgcaggaatagtgaccgattcacccgctactggcgtatctgcaccaacgtgaataaccactgggacagtgggccctatgatgacttcgaaatgggcaacctgttcatcgctgccgggtaccactacatcagcttcccgtttgagcaaggggagcgcctggatacctcggacaacatctacgataaccctcaccgcagggagttcctggaccttctccatgaggtgatccagcaggagacccagaatgaagctgtctaagcagttcgttgccaccctgatgggtgtgcccacgcccgtcaaagaggccctcttcgagcttggcaagtggaagcaggaggggtttcctggtgggcacaaggtgttcaagaagacttaccggctgtgcgataacctggtaggtttcctggagtatcggtctctggaccaatccctccttgcaccgtggtggtcctacacgtcagcgttgttcctggctgcggggttcccaggagggtcgtatcccttcgagaatggagaatcccttgactgggcggatgagctgtacgataatccgaagcgtctgaaattcatcgacatgtgttgggaggttttgaatggaaacgtgtgattatgtgtggaaagagcttgcaccagaagtgaaagaggggctgttggccctggtgaagtggaaggatgggggcttctccgagcatccttgctttagccgaaactctcgtctgtgtaggaatttggcctctttcttggaggctaaaggtatgcaacggggagaggtgatggtactgacaatcgaatccatgtcaggtttattcctggctgaaggttttaaaggggcgtaccctttcgagaaggacaagaagaagaaagaccttcagcacatgatttacaccaacccccatcgtctcgaattcattgaaacttgcaggaggaaactggcatgaccctagacctaaacagagcacctgcttcggctacccactactccgtccgaacggactctccctttacaaccttctggagaaaggaaggtgatctgtttacccgtatatgggtagctgatgcagagggtttgcgtctgccagaagggcgtactcccaccccttacgagaaaggtgttgcgagtgtttatgccaagcccttgccatccccgcctcaggatgtagtggataatcctgtcatagcttcctaccgagaagcgttcagccccgcccctcaggttgcgtcgggagaaccccgggcacgtgggaaagtggactacagtagtctggacagctacgtctggagccaggctccacttcaggccaacttcttctccctggggctgaatggagagttgagctgctggctgcacatcgaagaaggcaagatcgtaacggtttggacggagcagggtacggtgtataactatcggacctcagaccgccaaccttcggtacctggtccgagattcccccgcccccagaagaaggaagaggcctcccctcaagagtgggacggtgaaggactccctcctgtcggctgcacagtccaactggtggacatctcttctcctgtgagcccgcctttcgatgagtggttgcttggggactacctggaggtgatcgcccacaaggaggtttgtggaaccgttcgtcctgtcgtgtggaatgacaggaagcagacgggatcgtccatccttccaaggctgattagccctgtgtcccaagagactctggctgccgagaaggaacgccagcaaggtatccaggaaatggtctctttggtgagcagcatggaccttgcccgtgccctggaagtgctgtatgatgcaggctatcgtaaacaggaggacaccgaatgaacacccatgaacgactgctacgtgctgtgcaagctctgcctcgggaattgatcccgtccctgcatgacctggtggcctggtaccactcaggctgcccggatgggtccccgtttaacacctcccgcaggatatgcgggaacgtataccaacacctcatctgcgaaagaggggtgagtcctgaaagggcctgtgatctggaggactgcctgtactccctctacggggccttcctggatgttgacctcagcgacgaggggtacccattcgacgacgaagcgacaatctacaagaaccactacgacaacccgctccgcatggccttcctcaagtgtctgtcggaggtgctgtgatgcgactcaagaggattgaacagataaacttcgagaagttctcctggcagactcaggtggccctgaaggagctggctcgttgggtgtttgaggacatgggtccttggactgagggcaagtcccaccctgccttctacaaaggctatcgagtatgcaccaaccttcggttgtgggagttgcagtacggatggggggataagcatgggaggatgattcagaccgagttgtctgaagagttcatacgtgtaggtctgtgcgcagacctccccttcgaaggtggtgtctcggatgacggcctatacgtcttggcagaagatgatgtcaaagagctgtacgacaacccccttcgtcagcggttcctccggctggccctggaaaagctttcaggccctaaggtagaagtcagcgagatgctggaagacgccctcgcagcagtggcccggtgggccattttgaaggagtccttcccctgcttcgaacctcggttccgaatctgctggaacgtggagaactaccttacctggctagggaaggataagggagaaatctccaaagcttgtctggagttgtccaaagtcttcggcgtcctgtatcccttcgaaagtgcggcagggtttgacacagaggaagagatttggaagaatgatctccgactctctttcctggctcaatttatctgaggaggtaatatgcgtgatgtgacctgctttactcaaaaggaagcccacctctacggtggaaggttggggattcaagacctccaattgtacctccaaggtcaagggatgagcgctgacgaggcatcccgtaaggttcgattcctcgtctccagctctggtgtgtccttgcaccactccacggttcgagccatcgcaggctactgctggagtgcggggttcactttcgtggacattttccctcttctccgggctcacgggttcagccccgcccagtgttgggatgaatttcttcgggtgtggtggtggtgggaaaacagctaccgtcaggacatggagagccgttttaagcttatggaaggcagcttgaagcatgagtgacatttaccaagctcaaaaggaatttgccaaagcctgtaagagcacgtctgtggtagtctggtgtaggtgggcccaggctggaggactctggttttctgactgtggcctggaatggggtttcattgaagacggtcctcaagaaaatggaatgaactactgcccgaagtgcggtaagacgctactatcaaaaggaggggatgagaatgcagggaattaaactgagcgacgccatagtgcagggtatgggcaaggcgctttctacaggaaagctcagcgctatgtgtttccatttgatggaactcctacctcacgaacaccctgttcaggaggaattccactgctggctggaggcttatctacagacgaaaggccgtgattactcctttgttcggaccatgcttgaagttcatttcgaggagcttaacccaggcaccctccttacccgacaagaccttggccacctgtggtgcaacttttatgtgtgggccgtcttcgacatgaagcgaaaaggtctttgacttaaaattacatccctgggaggagcagatgagcgaacgacttcggagactggaagctgagtattcacgtgttgaacgtgaatggggtggcctagccaggtatgagctggagatgctcaggatacaaatcgattctgaaagaagaatcagtgagcgtaactcgtatctgtcaatctttggatgtgggaacgcattccacggaaggaagtacgactagcttagcaggccagacgttaacttgtgctggagggttgacaccagatagcccctccggtaccttgttttcttgactttaactgaggagattttaatgaaaacttatgaagcttctgtgctgttcgatgccagtctggcaggctctttatctgttgaggccaacagtgttcaagaggccatcaacctgctagaagacaaggtgggttaccactccccaaccttgtgctaccagtgtgccggccacctggaccttggggacatgacgggtatggtggtatactgcgaggacgaagaggtagcagacaccacctacgccggtgaggtcatacgcacgctgaacaagaaggtgaaaaccctggaagagggcctcagcaaggcatacaagctgctgagtgaaatccgtcccagcatccctcaggatgtcctgaagctgtggtgtgaagaccgagataccattctctctggcctgaggagtgctgaatgatggaaaaccgtaatgggaccactgaaacagcttgcccgaagtgcggaggctctggtcacgcggattctggaggtgttcaatcttggggtgagcctatctccatcccctgtgattgcctaaccgagcaggaagagttcctggcatgggccaatgaggaatacgaggttgaagagggctacgagttgaacgaaagcaaccccgccgtaatggaaaacaagaaaggctggatggcccgtgccgccctgcccaagcgttctaaattccgccaacacctggatgagtgcgccgacgaggttgatacttggccctcttataagcgtgaagccctgaagaacccctccccgaagtgctcgacctgccacgatcaaggcgaggtgttcatcggccccggaaaggtcgaatcgcacatgctggaagagccggaaccgatctacgcaccgtgccctgactgcgagcaaccctccccgttgcagtccgagcaggcagaggcggagcggccggaggtaatcagggttccgtcatgtgagaacagttatggcttcggatatgtggacggaagctgccatgttgatttgcggaagtaccgcaatcaccttgaagacatccttgattcgctcccgaacgatgaaccactgatgaccgtctcccagcacgagcgcatcgtcgaggctctccggttcgaacgccagcagatggaccgcgctttcactgcgtgcatcaacgagcgcgccgccgccctagccagggtcgctgagctggagaagccagaccctgactacacccagcacccgcagatcgtaggctacgcccgtaagaaagagttggagcctttgttggacccgtgtcaacctgatggcggccacatttacataggtttggaccatccggcgctctgggcagaggaaccgccgtatgaattccttactccgctctacacagcccctgtagcccaggatcagcaactccacgacctggacaaacagtgtcgcgatgacgtagcgcgtgcgctcggcttgcacccgtctcaggagcgcggtttcgcatggtcctacctactggcctcgatcaagtcatgccggaaggcgtccgaggatgccgtccaggctcagcacagcgtgacggaggagttcagcttcgagtatcgccaccccaacggagagagccatacggtgacggtcagtcgggatcaagtgattaatgagatgcccgatttcctgttcgagacgctgtgcagcaagttctgcaactgcgagccggcgggcgagacgaacgttgtcgagtgttgctgcgatgagtacgcggaggaattcaaactaatcgccgccgcgcccggcaaggaggtggtgtaatgggaatctggatggaagttaggtgtgaggaccggttcgaggagtggtccgaaggtcacggctatttcccgcacaggtgttggtctcacgaaaatgaaggaccaatgggagaagctcctgaaacaagggaaggagtgattaacacgtacagacacctggaggaggaagcccggtccctggggtgggtaaggttccgtcacgggtgggtctgcccctattgcaagaacctcaggcctaaggtatagttggcttatctgtcggaccatccactcgtaaggaggattaagaatgaacattgattggagtaaggcacctaagggtgcaacgcactgggagccaaatggcccccgaatcttcgaaagctggatgaagaacgagggtgactcttggttctggtgggacgaggttgaaggaaagtggagaccttctatccctatctcagaacagaggctggggacattcgaagcgagatcgcaagagacctggaacggccagggcctgcctcccgttgggacggtttgcgaggcaatccacgaagacatcaactcaggcaagccggtaaaggccgagatactgaagcaccacgacaacggtctgtcggtcgcgttcttctgggtcgacgcacctgtcgaagccgaaggaaatctgtactgggcccaacgtttccgccctctgcgcacgcccgagcagattgccgacgaacagcgtcgtaaggacattatcgagttggctaacgtcatccgtgatgctggtgatggaaatgattacatgctggcagaggccctgcatgacgcaggctatcgtaagaaggagtctgatgatgactaacatgagagaagagtttgaagaccgcttcccgattcctgaaggcatcgagtggcgtaataccgactacttcccggtgcagaccgataacgtgcacgtctacgtggcgctggcaggagcggctgcaaggtactcggcgatatggcaagcctggcaagccagccgagcggctctaaaggtacagttgccggacgacgggatcgaggactgccagcgagactggcagaactcctgccgagataacttcgacacaggttactgctatgcaactgaccggatcattcaagccctccagcaagccggaatcgaggtggaacatggctaatcaatacctcagacccgaccagatggtagagcctggctactactggtggttgccagaatatctgagcactagcccagagaagcaagagaactggcagataatctgttggcatcctttagacacgtccagggagcgtgtcggggtattcgtcggacctttgactccacctacggagaccaagttatgaccgatcacgcaaagctgcggaggctggctaaggcggcaactcctggggagtggcatgccgtgtgggaggaaggggatgacgcagcatgggcgaacctattcccggtaattcaagctgagaacggcgagatagtggtaggcaacgaaggtttctactccgacctggagcgggataaagctaacgctcaattctgcgcagccgccaaccccaggaccgtcctcgacctgctggatgagattgccaggttcagggatgaaatcgtagccctgcgcgaaaaggcaagggttgcgccggcccgcctcacgaacagcgacagtattggcaatatgttgcgagagattggttacgccggtgaagtcaattaccatcatgcacgagaaatttggaacgcctgcatcgacgaacaggagcgcctcagcagcctcatggtgagcgagcaagagggaggtaatgatgtcagcaatcatcagtgagtgcggtaaatatcggtaccgcctggatcgagactgttcgccaccctttgagggtagcaaggtgtacgcctacttcggtgttaaccccagcacggcggatgccagtacagacgatgctaccgtccgaaagtggcgaggcttcaccgagagaaatggaggccacaagttcattgtagggaacgtcttctgctatcgggccaccgacgtgaaagagctgcgaaaagtggacgacccgttcggacctgaaagcgtggattacttccagtccatcctggccgaagctgacatcctggtgccgtgctgggggagcctgtcaaagctgcccaagcaccttcgtgggtgccctcctcaactcctccagtggatgctccgctctagtaagcccgtcatgtgcttcgggctcacccaatgtgaccaaccaaaacacccccttatgctggggtacgacactcctttgcaggagcttgtagggagctggtgactcttttcacctcgacttaaagccccgggccttgacaggtctggggctttgtcgtatctttctttcaacaaacaggaggtggtatgaacggttctagaaaatttcacagccccgatggtccagccttcttcccgggtgaaatatgggtaagttgcgaggggtttgaggttgagattttgaaggttgagcggtacggtgccgacaagtgggatgttgacgtttactacatccagtgtcggtggaaaaatgcagatgatgctgtatttgtgaaggatgcttggaatttccaagtgagatatgaacatcacgcagataggagggtacatgaaaaaattctctgagacttactactcttggacgggggcagccagtcgggcaaaagtccttactgacctgggttggattgtctctcttcacagggagaaggttgaaggttctactagtcttgtttggaaattggaggcaacgcgatgagtgagaaaggaatgatcctggcaaagtacactggccttctgtgtggggttaaagtcctacaacatcaaggagacaaggttcgggtcaaggttgtcgatgaaaagcgtcctaagtgggttgacctgtcttctggctcctacaagctattcaacgacacggaagaagcaattcagtggatagaagccctgaatgatgaaagtgaatcccatatgcgagaatacttcgaaaatggatgcctctgcatcctgcgggacaagaccatggagaaagctccagcctctatgcccgatgaagacgctgtgaagttctatatggataattgcaaatgcagtcgtcaccctgatcacggattccggaaaggttagtcggtcgatgaaaggtgtccatgagaaattgtccgtagacgtttgggggaaggtagtggcatacgtctccaaccttcgtaaatccagccccctgcttgaagagttggttgtactcgaccatccaggctttaatcctcaagaaagacgtacactgaattcccggagaaaagcgtatcaccacctggtcgccctgttcaaggatttacgccagggtgttaaccattccaaggcaaaacgtctccatcgcatagcctcgatgctatcgaagtgaccccaaaggcagctatttagctgcctttttttttttattgccctttttcagccctgctttgatcctcgtcccacatttccgtacaaactgtagtccccttcacgtcttttgagaagacttcttttgatcctgtacatacccccctcctactgcgaagtctattgtgtaagtttggcattttcaaaccggtcctgcccttcatctttctttcatgcaaaagaaaaccccgccaacttccgtcagcggggtttcgttcaacccgggtattcgaccctaggtgttactctcagagcctgtgcaaagatagtcatcaggcgctgtccagtcgtctttcaacctggagactgtcaaaggaacgcagcactctttacggaagcaggaagtctcacacctgtgatgacacctccctccgtccaggcagcgagttcccagaatttcatcttcccctgccagaataccgcactcagctttcaagtcggcggccttaatacgattaagctccattttcacccatctccttctctcttgccgtttcaaacctggagggaaagatattacatcctccgcgttttcttccgtcaaaacggaagctcccacttgatgaggctttccagggctacctcgatatccttagccctcaaagggtcttcgtggccttcaacgggaaatgttgcctcaacttttactgcatcaatgagacaagctcctggaaccttccgtactactgttgggaccacgatggagacgatctcacacgccggggcatagctatagacctcgaactcctctgaagccccttcatactcattcccttcgggagtccaccgcttccatacaacgttgacgacaatcttcattcattccacctcgtaccaccatgatcttttctttccagcatctgcttctcttgggcttcctggaacttagactcatcccaggaagacttagtgtcaaccaggattgacgccagaatacccaggattgccaggacgatcatcgcctctgtcagggtgaaccctttttcctttttcattcagcctccttgccctggacaagcaaggtattggcttgacgttccatctcggcgatgtgaaggcgctggaagccgttctgagtttccatgggagagagcagtacctggtttgccgggtaaccttcctccggcgtttctttggtgtcaggctggggcagatagcggcgccgttccagctcctcgaacaggacagccatatctttgtccatctctcgggtacaggtgatcacaccgttgattttccagcccacaccaccaccgtgtatggaagtgacactgacagtgaaagggtcatgtttgttgctcatttgggtctcctgaaggtggatggaaagaacatcttgttgcagagcgtccaggtaggtgcggacctctttgtttcggttggcctgactgtccaggtggctcagatgtacatagcttgcagggcccagccgtgcagccctgtccgaaaccaggttgaacagcttgagggtatctcgcttgagatttcccgacagaactatccaggaaggctcaaactgagggccgtctgcatgatcggtgtacaggtctacggtcagagtgctcatgtcataccccgttgttaaccaggtaggtcaccagttcagtccggagctggatagtgctgggatgaccctgaagggtccaatcatcgtactgcccagccttctctttcaggaagctatacatggcttcctttaggtagccctcgtcgccagtaaattgccgctggcagaagactttcatgccccggacagtatcttgctccaggatgagggtaatcggtcggtttttcatagtatctctcctctttcacgggcttcatcctcgacatcatctgtcaaggctttctggaactccatggtacacaggtagaccatttcattcaagattctcttgttgagtttctttctccggttctcatgctctactacctgagaagcttttggacgtttcggaagcttgcctaccaggcagtcgtactcctccacggtcagcaccctgcttgcctggatacatccaaaaccctctccaagttcggtcataacttccaaataggagacgtaagctagaccatgaaaaccctcttccaggctgtttagcttcaactccataacagctaatcccataatttgtacgccctcactgtgccgcccgagtaaatatccagtgcctttgctgcctcaacagcctcctcggcactggcccctgccatcatggctcccatggcaaactgtgtgcctgatcccgcagcccttggcctgtccaggttcaccttctcggtgtagatgcctccgtcccaggagatgaagtgcagcccgtccgcatcaaggactagaccggagaccttcagctcctggtcctccattacatccccgtttacataggcctcggcgagaatcttccagtcgaatactgcccctgacagccagaaaacacagcctcctacctcgatacgtttttcagcgtcctcgttggtgatgatactgttctgagtgatccttccatccgttgctacgatcccatccttgtaggcgatggtggtcatgcctttccaaccttcttcaggtacagacgaatcagcgggtagctgataggcagcagtccaacgaggattaccactcgggcaatccaccaggtcagaaggacagcagcatcccacacttccgcgccgaggaatgccaagtcctctcggttgaagggagcatggaagtggagtttcagttgttccatcttggacatctttttcattattcctcctatgggcagcagcggggagacccgccgcagtagaattcaccttcctggcagtgtccgaagtagttggggtaccctgacctgccgcagtctcctgcacagtctacttcttcgaccatgccgttttgtatttcattctcccacaacgcttctcggaggtgtaaggacactttttgccagtcaaatcccattatagctcaccgagtgggctgaggacaggtcccagataaggcaatctttcagaaccagctccgtccgttcgggtccatctaatggaaccagtgcggtcatcgaagtaccgtcagagtaggaatctttcacatgaccgaaacctcccttgaagaggtatgtacggtaaatcaggtcatcatcgaacccttccacccccttcaagtacagcacgacactgatccctcgctctaggttcgagattgcctcttcgaaattcacctgcttcattcttcctccttcgcttcaagccacatggcacgggtttccaccatgatattgtccagggttgtattcccgtataggtgcttcttgcagcgggtggcagcaacgtacaggagattctgctccatctcgttcaaacctacccaccgcttcttgtcatcatacccactcggatagtcgtcagccaggacaaccacatcaaactcccgacctttggacttgtgtgcagtcgtcagtacgatgtctgccgagggatcattctcatggtcacggagggccttgaaaatcttccactggtcatccccttcgatgatccggcacaccctgcccagttcgcccgggctctctgcgtattcgtcccggaactcttgccaagaagtgtagcacagtatgttttcgtgcttcaccttcttctcgtcaccctggtacagggcggtagcactctccaacagccggataaagtctcgggtgtcaatctccagtcggacactctttccctggccaatcaggtttacagcatcccacaccaaggcagcgttagtccgatagagccgggcatgctgctccgggatttcaggtaccccttcagcgtcaccatctgccaggaagccgttgctctcccataccttcgattccagcttttcccacccatgcagggcttgggctttgctgttctgtaggataatgttcgccacttcagccaccttctcaccgaaacggaagctggtggtgagcttgcactctggggccttaatcttggccatagcgttcacgctgccacggaagctgtaaatctgctgccgagggtcaccgaccatgaccagcagggagtcctgctgacgcagaacgatgtccaggacgcaatcgttggtgtcttgggcctcgtccagatagatcaccttgtactggctgaggtcaggcttggagagctggtacagcttcaggtaggtgtcgtggttgatcagcgtctgctcgttcgggtcaatacgcttcttccacaaggcctttgcatagcggagaaccagggcctcatagtaggggaggtctacacggtccttctcggaaagctttgccaggggcatgtagctgatgtgcttgacctcaagctcctcgtctgccgaatactcgaagcggttcaccgtatcgcggatggcctggccaatgctggaagccgtgatggtgatccccatgtccgattccatgctggcgatcttgaagtatcgggcaatctctgccccggtccccaggacgttgacgtagccccctttcgggcggcgaagtttctcgctgagcttggccccgaacaccccgtatgccaggccgtgggtcgtcttctttaccacccactgcgggaacttgttcttggcctcttctgccatggacttgttgaaggccaggtacagggaggtaacctgtaggcgttgagagaccaggctcatggtggtggtcttcgctgcaccggcccccgcattgattttcaggcggcgattcggacgttgctctgctgccagttcttcggcagcttccatgatgtcccactgctcactggtcggggtgaaactcataaaaattctccttaaattcacaaagcttggggtatgccaacaaggccgccttcatgtaccgactggcttgcctgtcgtcgatgaggagtagtttacggacttcctctgtggaaatcaaggggaggaaggtaaatattttacgcagagccgatttcgacagaggcacctgtctgtagttgcctgtcgtcccgctcacaccctccttacccccggcgctggaccggtaccaatccaggttggcaaccccgtggaagatgttgtccatctccaacggccagggatcatccctctcaaacgcgatgaacgagaacaagggcatcagttggttttccaactggcgccccttcttgttccccttgcgttctttgtcagccctgagccgattagcccgcttaatcagctcatttgcccgggcttctattcgggaatagtcccgtatcggtcctccattctcttgatccattctgttgcccaacctctcgattcctcgttgtgaaggttcgtcacccgaacgccgtgcgccttagccagcttgacggcggtgtttgtgcctccctggacacttccgtccttgttcggaatagcgaagcatattaggaactcactgggagtctccagatcatcccccagcacctggaagacattcctggtgtggagcttcttcgctccgatgctgagatgttcccatgcaggatggaactgctgggcaatctgctgggctctgacttccaaaccgtaggagatgtgggacagggatactacggcgccataggcatctccgtggtgcagcctgtcatagaaaccgttccacgggatatagattcgccccttagaagtaccatctccatcccaaatctgatgcttccaccagccttcctcaaaggcttggtctgcacctggcgctccacctgtacggagggtcaccccagcggccgcaaggtagtaccccagcttgaccatgatgtcaagaatatacccaggagtctcccgtgaccctacacctgtgtagaacagactcatgtggttacctcgaaccctttagattccaggaaggacgtgatgtcgtatacctccatctctcccaaaatgtcccggggatggatattggagatgacgtaatccaagatatcatcatcatccagttgatccagaagagcatcgaccgtagactttacacctgatagctcgacagccacttcaggtccggaatacggactgtacgttgcttcaacctcgaccttcttggcttcgattaccagttccatacttcctccttatgatttgtagtacacgtgccgctcgattctgagcgtctttttcatggttttcgtccagcggggcatatatttgaccttcgcagggttcaggtagtgatcagcaccccccgtggggtctttggacagaccttttaaagccctccaggccactaccttagattgatcccactgggccttctcttggattcctgcctttcggcttccatcacaagtgtacgagaactggcaacggaagtacaccactcctggaactgttgaaggccatcggtctgggttgttcaccctattgatgatgacgtgggctacaccttccttccctctccagctctcaccccgggcttcgaagtagatcgcctctgccagggttctacaagacttctgacgctcgcacaataccttgtaggtttctcttttctggacttcatccagaggttgactgctgaggaccgctcgtttctcaagaagatggaagcgagaagtctcaatgcctaccatgatctcgaacagtagtccggacgcggccaatagagtgctcagacagagcgcttctagggtcttcattcgggctcctttctatcaggtgggtggtatgccggcattgcgccggcacggattacaggaacgaggccaggccgttccggaacacagggaaggcggtactcaggaattcccggctgaagttttcttggcagaacttcacttcatgcttatagcagaagatgacgaagtttgcttgcttgctcttccgagtccgagtcaggaacactcgtttgacgatcttcgtagcctggctcaactggaagccgtaaggggtcagctccaggcctttcagtttgggattagcaggggccaaggtgccgctgcctcgaccagtttccagccacaagctcttcggctcgttgtgaagatcgactgcggtctggaaagacagcgtttggaggcccttactcttcagctcgggaatgctcgtatagaaactacccgtctctgccaggaagccatagcccaggctgcccatgaaacggatcaggctgtccatttgaagccatgcagtgttcttggcggtcgccgagtcgaaagttgtacgatgggtgaatcgcaacagcattttcatagtaaactccttctgtgaactggaggccagtatgcctggcctccttggggttgtcaacctcagtctacgggatttccgttttcgtccatttcacgccagcacaggccgactgggaactgtggaaccagggtcttcttgaaacggccttggtatttcaccttcaggtaacgcccgatgtacttctccggattggccagttgatccctgcgagccgcatggtctccgaaggttgtatcgaaaattcccgtggcgtattgtccacgaccgtctgctttctccttcactttggggcagaagacgcggagaactgcgttcccgtctttgccttccaccacgtcaacaacctcgaactcctcgtccaggaatttcttgtacttctggaggtcggaagatcgctgagatgcttcgtaaagccccgtcatgttccgaagcatgatgccttcgtacccttccatgacaaccttatcgtggtacttgtctacatcctcccggaagaagattacgtcctgatctactacaaacagggtggggttccccataaggtctgcgctatagacaattcgacgaagggcgtctagacgccaagagaattgggtatcaacggtaacacccaacgctttacaactcacgacatcgaagatgtggtattgcaacgccggacgcagagcagcgatgtggattgccaggtccaaggcgtcttgggcttcctggagttcagaatcatcggaaaactcgtcgtccgcgtacttcataagcttcttctcagctttctccacctctttcagggtgtcagtacgcttaactgccgactggatgtcttccagggactcaccgtgcaggtaaatctcaccatcaaaaatgtctccaatctccatgatctgggccagagcctcagcaacgtgtggcaggatgtactgctccccgccccgactacgaagctccacacgcccatcttcatgtcgaagagccaggcatcggacaccatccatcttggggctgtagatggcggggaaggtgatggacttggagcgcttcaggtaatcctctgccagcataggaaggataggaacatggtccagatcactcttatcttctcggtaacctgccttgaattgcttctcaaccttggaagtggcttccagatgggcctgctgctcgccagtggtctcgtttgcacggcctacgttcttcggcttggaggtggtcaccttgacagtcagctttccaccctcctttccatgttccacgaataccttgtcaccttcactccagcagctccactgcttgaagttgccgcccttgtccttttggtacatcgtcactttttgcataaaccctccttattaacgaaattcaccgtctgagctttttaccagaatggcaaactcatccacctcgccgagcgcttgtactccaaactgctcttcatatgggttgcttccatgctggtcagcaacatgcacagtagtcagatacagctcatccatgaaggctcccaggggagttgttgccgccactgcggataccttgcctacaagagctgcaagcatctttgtctcttcgtaagatagctcaagcaacacccgttcgcgtttcttacagtcttgtgcgtacatgtttaatctccttttggcatgtggatgacttcaaccccgttcttcagcaggtaatcaatgcctgccgtcagtcggtactggtggcgatagtacaccctcttgatgcctgcgtcaacaatgtcgtgagcgcagtattcacacggggacatggtggcgaacatccaggcaccctgagcactctcctggctgcatgagagccatagtagagcgtttttctcggcgtgccgtacctcgggcctggtaaccccctcctcgttctccagagggccttccaggccgcttgggaggccgttgtacccctgactgatgatcttgtttccctggacaatcactgcaccaaccttcgcacgaacacctacagagcactcagcgaaggactcggcgcagcgcatgaaagcctctttatgcttctgcttcacagggagtacccctggcttttctctgggtattccaacacataccggtttttaacctgtacaccgttgatggcgttgtacgagtcgatgcacatgtccagaaccagctcagcaaaggattttgacaggtccatccctgtcaggtcttcgatatttgggcaccgacttttaagtgcgactgctccttcgtaaatctcctgctgagcaatgatagctttttctaggtgtccctcgggaatatgtacgtctgggtcggtagggtccataacccacacctcagcctttctcacggtgtttggccagataaggtggcagtcccgccatttgttcggatgccaggataataggcgatccagaagtggttgatacatcttgacctttgggcggtaaaccgtgagcccgttgttcagtttctccaccacaatcattgtcttcataacacctcctaggatggcttgcgttggccttttctggttgctgtcccccggcaggtgaggtctcctttggcctgctgcatcttgctggccttcacagtgtaccgcccctttccgtactcttcgtctacgaacgtctgggccttcatcctatctcgggtgtgtacgaatacataatcacccatagcgttctggatgtaccaggtagctggcggtgcgaagtccaacgccgagaagtcctggaaggtcaccacggtagttcttggggtactgctcatgtctactccttgcgggattactttgcagggggcatcctaacccaatgcacctgcaatgtcaacttatttcaggcgcaaaaaagcccgccacactgggcgggcttgattgatcagctttccactgcttcttcagcaggctcagaaggagcctcttgcttgggacgcttctcttccggaaccacaacgctgtacagagcctggagcatcagacctacctggtcctgtagttcggcttgcaccacggcgtagcggccattcacttccatgtagtccttggaacgcaggaaggagtccaccttgcggattttcttccaatcggtgccatctgccgtcatcactcggtcgaactctttggccaggggttcgaggttgaccacctgcacagcctggtacagtcgatccagagtatcttcgtccggcataatcggtacgagaacactcatgagggcgtcatgtgccatttgcttgaacaggtcctgtcggttcagttgagttgctttctcagtcattcattctctcctttttcaatttgttcttgctcagcatcatcctgctgcttaggtttcggctttggctgccgctttttacgggcaggtttctcagtagcctggggctcggcttcaggttgtgactcagcttcgggctcgggctcggaagaaccgaagtcgaacacaacgttctcatcttgccccttctccaggacagcccagtgcaggctgctggacagcatggacacacgggaggtgtccagggtgtatcctgccagaacctgggattggaatgcaagcaggaaattcatgaggttgtagtctttgacctcaacggcgttctcagagagactcttgacggcctccgggctggcgacttcagtcgggccacacacttccttgtggaagagggtgatggtacgaacacccgaagcagagctgaccactgggaatccagccatggtgttctcaacacggtagccttcagcgatggcatcttccacggcttgcaggaagctgatggggttttgttcgactacacggatacgcttacgatccgctggataagcaggttttacggacattttgattcctccttgggattgagagtacactataccaccatctgaagcagaagtcaagtcttgacaagctaaagaatttatagtaatattattaaatatattatatataatatacaagggagggagtgggcaagtgccccctcccttgtactaagtatataattaatattaattactataggttaatttttatgagatgtaaaggctgtaataggataattaagtatcctagtaagaattcagtatcaggtaagcatgaagacctctgctccctgtgtcaaggccgtgccaagatggtaggccctactgagaactacgcattccctcatgcgaagcagggcttgacaccagtccgtcaatgtgactagggattgacaaacacacctacaggatgctatagtatctatagatacaccagtttaagacctgggagggttcctcctccttcccctctcaggcacccaaccaaggagtaagtatgagcaagttcgtaaagggccagagtggcaaccctcgtggtcggcccaccaaggaagctcaggccctcaaggcgatgtctgccggagagcttgatcacatcctcaaaaagctgaagcctgccagtgccaaggctattcagctcatgatcgacgaaatgaccaatgcgtcccagacatctccagtacgtctcaagatggctgacaaggtgttcgctgcctacctggcagccctcagggcacaggcgtccattgacgcagtaaagaacaagtctgacggtgttcctgagcaggaggatgaacctcaggcccaggtcgtagaattctcgctcactatgcctgccaagagaggagcatagcatgcaagtcccagtagaagtaatggaccgggtgttcccggagtcaagggtgtatgtggaatcagttctggctgactgccaaaccctggaagacctggtgaatcacaggatcagcctaagccgtaagatgggcctcaaggttccaggctctccggagtaccgagagctttggctggctgagcaaagtatccatgagattgagggctatgtcctcggctcttgtggtgtaggggcctcccagccccactaggcgttcccggagccgtatggcgggaggggttgaaggttcaccacacgaaccccctacgccccggaggttgccggggtaggtcctccaggctctaaagtcctggagaagtgtcagccggacctttgaggatgggagtccaccggcactcttgacacggcgtactgaacacggtttaataccctccacgaagaaacaggaggtaccatgagaaacatgttcgttacgccccatgccaggaaacgctttcgtgagcggttccggctccagttccacccctcggtcttcgaggacggtagagacatctacgtcatccggaagcttttcgctgaagcgaaatactgtgattttgagcttcgtatgcggataggaaactataacgcgctctgcgtaaagcacggcagggtcgtaagggtttccaaggttcggaatttcgtattcgttcacgatgactcgacgatctacacaatcctgaaggaagggatggttctgtcaaacgtgaggttttagggtaggggtcttggcgaccaggttggactccaaattcaacccagctcagttcgaatctgagactgcccgccaaaaatctcttgactttatctgaaaatgtggtaaagtggatttaagagattcagatgtgggaccgacgaagctgatgtgcagaggaggtgatccagcatctcccggacgggtccgggttaccaacccgctaatttcatagcccgacagcaagggtagttcctgcggggccagggtccaagtgaccctcctacattccgttcggtccctcaaggtgagggagcttgactgttaatcaagacgtgcctggttcgattccagggagcggagccaaaagagtaacctccacgcataaggccttgcactgcgcaccaggaggttagtttcaacggaggggtggcagagcggtttaatgcaccggactgtaaatccggcgtccgaccgggcatcgctggttcaaatccagccccctccaccaaatgctgtgtaagttggactgttgcagtgaagcgataggctccccggatcgtaagccggtaacgtggggatagagggctcccaccgctgagcaacaggaggttcgattcctcaacacagccccaaaactgctccaggcagttcagctaggctaggcttgagaggtagtagcccgtttttccaaaacctctcacttacaatcaggcgtgtggcgaaaaggtttaacgcactggactttgactccagcatttgtgggttcgaatcccaccacgtctgccaatctacccgatgctaattgggtcttgtcgctccgggtcagcgactcagaagtgacccttagccccggcgatcttcgctggggctttttactttctcaacccgtaatggaggttgcaaatgacgttccaacccactcacgcacaagcaagcgtgatgtctgacgataagcacagtatcatcctgtacgcctcccacgcaggcggaggtaagtcccacctcgtagccaagtggctcaccgaacccatgcacttggaaggatatcgaggcttggcagcccgaagaaccattccatatcttacgggccctggaggcctggcgcaacagatagtggatgttgacccaactctacggttctttcgaagagatttgatggtaaggactccagatcgcaggtcctcgatagttcttcgaggcatctcaagcgaggaagcccctagaagcctggtaggattcgtatttcaaagggcagcagttgacgaagccaaccaggtagacagcagcgctctgacgtacctattgagcagactcaggaactcccaatgtcctgagataactccccaggttttgatgacattctctcacggagattattccagcacattcctagacgcccttgtgcgacccttcattgaaaaaggggatagcccacgaggacacggtggggtagggaggattgatcccaagaagagtggtcagaccaggtggctcacctttttacgggggttgccggttgtcgcaaagaaccaggagtctctgatagacctcttggagtgccacacagggaaagagccagaagaagccaacctcatcccatataccctgtacttccagccggacgttcacccggttgtgaaagaactctaccccgagtacgaatctcatctgaaaaccctcgcatcacctttaagtgttcagatgactggctactggggtgacgaatagccccgctatgcggggcttttttgtgcccagggattggccccgggcaatgcaacaaggagcctaccatggcttatgaaatgaccccagaggataaggtcctctacgatgcaatcgctcgaatcggcgtcctgggagctatccaggcaggcctgatgaaggcaggggacggtggggagcctgcaccggcaccgaccgtagataccctggaaggcgctggagccactggtaaggcagtgatgaaagctgcggatgctgctactgcacgaactgctattggagcaggaacctcgaacctggccatcggtaccagtgcaagcactgccaaagcaggcaactggaaacctgcctgggcggatgtcaccggaggcgacgcagccgtttctgcgggtgttaaggctaaggtgaattccgtcgcagcagtggccgaagacgccgagttggcagccgtcactgccaagcttaacgaactgttagctgccctaaaggcataaacagggactgggggcttgacaaagttaagcccctagcatatactgaccatataagcaagagaaactttgagggcttgacaaatgactaagacagtcatcggtcctaagtctccgaagcaggaagcgtttatcaactccactgcgaacatcaccgtgttcggtggagctgccggggctggtaaatcctacctcggagtgatggactttctaaagcatgtgaagcacccgatgttccggggcctgatcactcgacggaccactcctcagattaagggccctggaggtatcttggataactgccttcagttgtacaagcagtttgacaagaatgtcaaatggaaggataaggacgggaaattcgtcttctcctcgggagctgagattcaccttcgacactttgcccacatcgacgataaggacaactaccagggtctggaaatcaacgaatttctcgttgacgaaggacagcaatacaccctggaaatgttgctttacttgatgtctcgtatgcggggtccgaagtgtccagaggttgaacctcacatgaagatcacctgcaaccccgattataacagtccgctgcgtaagtggctgacttggtacctggaccctgagacaggtatcccgctcccagaaagggacggaatcactcggttcttcactatccaaaacggagacatggagttcgctgacacagcggaagagctgattgaaaagtacaatctgaagtctcctcccctgactttcaagttcatttcggcaaacgtctacgacaaccctgtcgtgatggagatcaacccccagtacgttgcctggcttgaaggtttgaacagggtcgagaaacttcgactgctccatggtagctggtttgcccgagaagaggcaagcggctacttcaagcgagaatggactccaatcattccgcttaggcctacggataccgtgcgacaggtaagagcctgggatatcagcggtacgcttccgtcagactccaacaaagagccagactggacagcgggcgtattgatgagcaagggccgtagcacgctatacacaatcgaggatgtggtgagggaccgccgccgtattggtggggtttttgaactgatccttgagacagcaagacatgacggagctgacactacgatcctgattccacgtgatccaggagcggcaggacagcaccttgcatgggactttgttcgccgcctggcagagcacgggttccatgccaggacccgtccaaccaacaaatcaaaggtcacccggttcggtccttttgccagtatggcagaggctggaggtgttcaggtagtagaaggcccctggaacgaggcttacctgacggagctggaggtgtttgatggaagccggaatgttaaggacgaccaggtggatgccacctcggacgcctacacttatttggcatccgacatccacattcccaacttcatccctccggacctgacccgaccaaacccgctggccattgaacgataggaggccctttgtggctcggagaaagaggaacgtcagaaaggcggcagaagtgccatcggccccccgccttcggctgggcgaaatcggacacacgggcctaaagcaaagcggtggtgcaatctacgaggaaactcgggctgagctaaggttccccgagaacctgaacaccttcaaggtgatggcccgagacgccaccattgcaagtgccctggcattgttcgaattgatggtaagccgtgtagaatggagtgtcaagggcggtacagagcctgacgctgccatgcaggagaaggttaaattcctctcccaggtcatgcacgatatggaccacacatggtacgacttcatcaaagaggtgaccagttgcttcacttacggcttctcgatccatgagaaggtgtaccggaaacggacgtgggcaaatggctccaagtacaatgacaacaagattggcctgaagcgtctccctgtccgttctcaggagaccatcaggaagtggcggttcagcgaggatggtagggacttcctcggtgctgtgcagtctcccaaactgatcagtggatgggagcagaggtatggaacctatctgaagaacctgcccaacggcggtgatgagattttcatcccgaaagagaagttcctgaacttccgtatcgaccctcgccgtgacaaccccgagggcaatagccctctgaaaaacgtatacttcgcctggagttaccggactgccctggaagagcaggaagccgtaggcattaccagagatatgaatggtatgcctaccctgtacatcccgcctcggtacatgtccccggacgcttccgacgaagagaaggcgatctacgagtattacaagaacgccatgcggaacatcaccatgaatgagcaaacgtcgctcattcttccgcagcagtttgacccggaatctcgcctcccgctgttcaagttcgagctgactagcagccagggcggtaagatgtacgataccgacgcaatcatcaagcgttgggataacaagattctccaggtcctgttcgcagatgttctgaagatgggccaggacaacgttggctcctacagcctggctggtgctaagaccaacctgatggctatggccattgaagcacgtttgcagatgatccgggacgtgctgaacaacgacctggtacctcaactgttccggttaaacggatatcgccccgatgaagagttccccaccttcgagttcggcgacctcgacgagattgacttggatgtttactccaaggcgatccagcgaatgatgtccgttggtggcctagagtttactcgtgatgtggccaaccgaaaccgcaaggccattggcctaccggaacttcctgccactcaagctatcgaccgagaggctctgcccttggcaaacgacagcaaggcaggggaggggatgaagacggcgggtgaagggacttctaagagccccagcgcccgcgatgattcaaccgcaaaccaggataactgaaatggctgaagaaaaccagcctactcccaaagaggacgtggtgaagagtgttgacaaggccgagcgccgggcactctttgtcgtcctggctccggatgaggtggaccttcacggggacatctactccgcagtcgaggtggagaaggcatgcattcagttcaaccggcactgcatgaaagccaacctgttccacgccgtcgagaccgaggctgcccagatcgagcaaagcttcatcaacctggccgacttcgacaccgacgatggacggaccattaccaaagggacgtggtgcgcttggatgcacttcccggaaggtgatgcgctggcagatgatctgtgggcaggggtgctggatggatcgttcaacggcgtcagtatcggcgcccgagcaactgtagaggacctcaccgatgagtgatcgaaaagccaaacgccggctgaccgacatctcttttgaccatgaaggcgctcatctggcgctggtccataagggacaaggtggccctgcgaatgggtatacgaccctggtaaccaaggcacttgacgcgggaatcccgcaagacgtgctgaaagccaccaaggtcaaagtggagctggagttcccggagttcctccggaagttcttcaacatgtactacagcgatgcagagatgttgtctgctgccctggggtacggcaccactgaagggaaagattggcagatggacggagagtcgtaccaagagtacatcgaacgccgcgtaggtggcatcgagattctgaagtccctgtacaagagcgaggaccccgttgccggcttgaataagcttgacgacgcggcaatcgtcagcatcgcgaaagctcgtgacctgctggaaccccatatggccaccgcttctggggccgaccacaccaacaaagaggaaagccctgtgagtcaagaactcatcgacaaagctgtacaggcagccgaagcaaagctgcaagatgaactcaagaagcaagccgacctgctgaaggctgctaccgaacaaatcgccgccatggaagccatccagaaggccgctaaggtagaagctcgtaaggccgctgtagccggttccggtgctgacgctgaagctcaggttgagctgatgaaagccatggaaagcctgagcgatgaaagcttcgctgtcgttctcaagcacatcaccaaagcaaaagaagttccggctggtctggaccgtgaagtcggtctgagcggtgcatctgacgctgaaaacgctagccaggtagagaccctcaaggctctgatgctggccaagtacaccaagcaataaggtataggagcccatcatgcccgttatcgctaccgaccatcagcgcctgagcaactggctcaagtatgaatacgacccggcctccggcgtaacccgcgaagtcatgccgaaaacctggctggacccggctgtgaaagagaccggctcggttctggacgctgacggcaagctggtcaccaaggcgaccgctgccaacgctgcctacatcctgatcgattgcgagcaccgcgccgctgctgaccagtttactcaggtcctgcttctggcacgtggctacgccaagatcgccgacgaaggtgtgatctttgcggacgatgtagaagccgcagacaaagaaaccgctttcgcagaactggcgaagaagaacatcttcgctgtacaccaggtataaggaaggaaccatgcgaccgattccctcgcttcagaacaacttcgaatacaccgacctgaccgaaccgatgatcctgatcccgaacgtgtggggtctgacccaacagctcggcgtcttcggtgttgaccgtaccacccaagagtccgtgactctggaagaaatcaccaagtcgttcggcctgatggaagatatccatcgtggcgctcgccaccaggttggtcgtgactatgatcgtcaaatgcgcaccttcgcggttccgcacttcacctacgacgattacatcaccccgcgtgatatccagggcaagcgtgcctacggcaagcaagagctggaaaccctggaccaggttcgtatgcgcaagctggagcgtctgcgtggcactcacgccgctaccatggagtttgctcgtatgcacaccctggttaccggcaagccctacacccccaacaacaccgttggtggtgctaccggttacgactggtaccaagagttcggtaagacccgtttcgaagtcaacttcgagctggacaccccgaccaccaacatcctggagaagagcgagctggtttacgctcacatgcaggacgaggcctacactggtggcgtagttggcgatgttatcgctatctgctctccggagttcttcagcaagctgatcagccacccgaccgtggttgaggcgtacaaatactacgccagccagccgcagattctccgtgaacgcctgcgtgcccgtggcttcgacgcccgttaccgtgagttctacttcggcaacgtgctgtacatcgagtaccgtggtggcttccaaggccgtccgggtggcgagaagcgccgttacgttccggctggtgaagctgtcttcatccccggcagcggcaccgaagacctgttcaagaccttcttcgctccggcgagcaagttcgaacacgtcaacacccccggcgaagaaagctacgcgttcgagtacgtggacccgaaaggtgagttcctggagattaactccgagaccaacttcatcaacgtcctgatgtacccgcaactggtcgtgaaaggcaaagcggcctaagaaaacgggggccttcgggcccccttttttggtcccgagaaaaggagtaggatatgccctacacaggcgatccgaagaacaatgtggtcgatcagctccgcctgatggtgggggatatctgggacgacattgaaatcttgacggacgaagattaccaatattttatcgacatgtacaatggcaacatccgcagggctttcctggacgttgtacggtcaatcctcttcaagctggcacgttacgtcagggaacggactggtgatattgaggtctacggaagcgactggtggaaggcctataggcaaactctccaggatatcctgaaggacccgaacctgacaaccgtgattgctctgccttacgttggtggtgtgtcagccaaagatatggccatgaacaacgccaatccagacaatgtggcacggaagattttcatcggattcaatcgcgatttgcggctttacgagcagcagaacgtggggtacaatgacatgccgagaatcgggaaggccctagatgcccagccgaatctctgctgactttcggaagctagacgctctgattgcccggatggaggccttggacggtctgacgctggagggaggcttcttccctgaagacaggtacggtccagagaatggtaacctcccagtcgcccaggtggccgcctacaacgttttcggtacggaaaccaacccggaacgagacttcatgactcccagcttcagtgactgggccacggtgaactactaccggaaagccatgaagcaggtggtagaggccaccattcgagatgggcggacccagaaggggcagctcaacaagatgggccgaaccatggtggagattatccaggtcaacattgacgacttcccaggccataacagcgctcgctgggctcaggtgaaaggctttgacgaccccctgactcatacgggcaagatgcaggatagcgtcaagtacaagatcgtgaggaggaagtgatgctcacgccacccatgctaagcactcacttcgtcaagaacgaggtgattcgccggcccaggaagcgcctggtccgaggacggcctgttcaagaccctccggagatttacattgtcgagggaagcttccagcctgtgctgaaaagcacggacacgatgcaactccccgagggtgaacggaccaagaaggctttgaaggtttataccaggaaccacaccaccctgcgagaagccaacgaggctgaggatggctgggatgcggaccagttctggtggaagggcgagctgtacgaagtcgtgaagaccgcttcctacgacatgagggtcctggatcacgtcaaagccatgtgtgttcgtgtggagggtacctgatggccctgaccatggacgagcttagggctaaataccctggcatagaggacatttacacccagttggaagatgacctctacaacgtggctgaggctgctttgggggatttccctctggtgctaagctactgtgataaccaacagacccagacgcctgcactgtacatcgagccgatggacatcaaatcggtattcaccgagcaggtagcaggcactctggagattgacccaacagacccggagagggctgtacaagaggtcaccaagtggtacacccttaaagcccgttttacaggcctagggagtccacacaaccacgccatggcagcggcagcagtccagcatttggaattcttcctcagcactgaggagggttaccaggctttggaatccaacgggttttcaaagaatggggccaatccaattcgtcggatcagggatcaacgtcccaatgagctgtaccagcatttccggtacgatgttcatctgtcctacgccataacacggaaagaagaggtgacctggatcgaagctttggagctggacgcggtttacaccaacgccggacgagagcctgaccacgttatcaagaaccatatctcactcaacgaggaaccctgaagatgacccgtcttaccgacatcatccagatcaccattgatcggcaaacgcagccggtagccaccactgcgttcaacgtgccgatgttcctggctacccactccaacttctccgagcgggcgcgggaatatgcatcgacggaagctgtcatggcagacttcccgaacaatagctccgtaatgcaggcagctcgtatggccttcgcacagaacccgcgccccaaccgcctggttgttggtcgccgcaacgtgccaggcgccactgtctccattgtagaggttgcaccgcagaccacctacaccatgaccctgaacggtattccggtgagctacctgtcgaaaccggaacctgtggatgaagatgacgagccggcagacacggcagtaaccatctgcgcaggcctggtagcagctttcaacgtcagcccggtcgttggcatcactctgaccgacaataccgacggtaccatcaccgttcgcagctccagcacctcctggtcgctgactacctcggcaaacctgtcgaagtcgaacatgccgtccaccgagggctggggtgccgctatcctggcagtaagcgctgcgaacagcaagtggtacggtgctaccatcgaatctcacgtcccggcagatgtcctggaagtggctgctaccatcgagtcgatgagtgcgaagaaaatcttcggtacctctaccagctccgtggctgtgaagaacgccactgctggcaacatcctggaaaccctgagcaaggcaggctaccatcgtaccttcctgctttggaatggtcgagctgaccaggacttcccggagctgggctggatgtcgagccaactgcaagagcagccgggcagcaacacctggagcttcaagggcatcgctggagctacctacgatgagctggacgaccaagagtcggcaaacatccacgaccacaagggtaacacctacgagttcgttggggatgccaacagcaccacgttcggtagcatggtgtctggtgagtggatcgacaccatggtaggcatcgactggtttgaagctcgcctccgggagcgcctgtggttccgtcagcggaacagcaagaaaatcccgtacaccaagcagggtaccaccatccttgaaacggatgttcgagcacagctccaagagggcattcgagtccaactgttcaccgacaccccggctccccgggtccgtgtacgggatgcaaacagtatgtctccgaatgatcgggctcgccggttctatgacggtatcgagttcgaagctcagctcgctggtgccatccacatcatcggtatccgtggcgtagtcacggcttaaggagtagacaatggcaggccgtacttccacttacgcccctaaccaggttactatcgtaatcaaccacgcggcttcgggtatcagccataccctgaccggcttcagcgaagacagcattgtctccgttgaacgcctggtggacacgttcaccgagtatgttggtgctgatgacactcacacccgggtgttcaacgccaactccggcgcacgggctaccgtaagcctggcccagacctcggagtcgaacgatgtccttaccttccttcacgagtttgaccgtgaagcgatgtccgcagacggcatgttcgagatgctgatcaaggacaactcgggccgctccctgtacttctcggacgaggcgtacattgcagtgatcccgcagggtggcttcagcaaccagatgaacacccgtgattgggtcatttccatgaccaacaccacgttccaacatggcggcaaccagaaggtgagccccgctaccgcagacaccctcacggctcttggtgtgaacctcgacgcccgctggctgtaagcgacaacctggccgcccctcgtgggcggccttttttgtacctggaggaaatatgaacaccttgacttactctccaagagaggttacgatcctgatcgccggagcccatgaagtgaccggatacgcggagggggagttcgtcacgatccagaaagaggttcaagcgacccagactcagcgagctatggatggatcagtggcccgcctctacactaaggatgacggctaccgaatgaccctcaccttggcacagtcctcgcctacaaacgacttcctgggcgctgtttacaacctggacgcagctacccgcaaggggaagttcccgctagtggtgaaagacaccctgggaaacacaaacttcttcgcaggcactgcctggattgagacccctccgaccgtagggtttgggggtactcttcgagaaaacgtgtggcgattcgcttgctacgacgctaccctccggatcggcgggaatagcgaccttactgacttcgagaactacctgagtcagggcgcagccatccttccaatccttcgacagtacggacttatctgatgacaaagcgtgtgttgacttacgcccccgaggatgttagactgataatctcggagtttgaatgcgtaggtgtagtctcggttgaggttgtctgggacatggaggtctaccgtaaagtggtgggcatccggggtcaggtgacccgagttcgaaacctcaaccagtctgcacgtatgcgagtagagcttcttcagacctcggacacaaacgatgtcttgttcgacatcctgacacaggaccgcgttaaccagtccggcaggctagacctggccctggctgacaacaacggtgataccatcatctacaccaacaatgcctggatttcaggccatccccagacccgtaggagcctggggtttgacaaccctgtgtggacgattgagattgcccgagtaacggaccgtgatctgtctggttcgaacaaccccctagacttcttcagcttcgacgggctgaagacggctgcgggtaatgcaatcaactcggtcttagaccaattctaaaaggagagcccaaatggcacgcaagcaacattccatcgaaatcaacggtgaccgtttcctgatcacctccatgccggctaccactggcctgtctcacctgaagatgctcaccaagcttctcggcccggcccttgcagaggcaggcgtaggctcgaaagagggtgcaggttcgatggacatcgccaccctggtcagcaaggtggttgagcggatcgacgaggttgaggtggaaaagatgatcatcggcatgatgaccagtgtgtccaagaacaacatggaaatcaacttcaacgaggagttctcggctgactttggcaagctgttccagttggtgactgaggtagtgaagctgaacttcggctcggtttttcaagcactcggtttcgacggtcaacagtaagtggggaggggggtgaccagatggtacacccccgcctaaagcggctcatgaaggagttccaaaaggactacgaggtctatcaggtgttgacgcactctctgcgcctggcgagccttcacgagctgcaaacgctgtacgataccgaggatttatatgacctcctagagtaccaggcagctcacgacgaagccgcagacatcgcccgagaaatcgccaagctgaggcaacaagatggcaactgaagagattacaaagctcgtcgggacgatccagtggagggcggataaccgccccctgctgacgttcaagaagaacctggaacaggtaagagaccgcctcaacgaagtggctggcctggccaacaagaaagtgacgatgagggttgaccttgatggtcgaagcctggcagccaagatcaaaatggctaccaatgcccagattcgtctcaagaatgtggacatcgcccaggacaccctgggaacgatggtcaagaagctcagtgagcgactggcaaacactccagtcacgctgagcaatgttcgtttcaacatcaaggatatcgcccaacagaagcgattccttcgcacgtttatgcaaggcttggctctggaaattcccgtctctattcgagcgaggaaggcagagcaagccctgttggcatggaagcggcagactgagcaacgcttcacgcttcacctaaatgccgacatcagtcagtccaagttctaccgaaatgctcgtcggaccatcgacgcagtgattcagaggctaggcactatcactctgcggacgccaaatatcaggctgtcggttgacagggctcacctccggcaggagattgcggatgtcctggcccagattcgccgagaggctagaattagaatcgatttgcaaggccatgtcaaccaggtaaggggtaggaatgcccatgctgtgggaggtatggctggtgctggtgcaggggctgctgtagcccactggggacgaggctttatccctggcctgggaggcgcgtttgccatctcccagatgaaccagatgggtcagcaaatgatcgcccagcagaacgccatggctgcggtaggtggtagccaggaagctggtcaagccactatggcacagttcaagcagatggccaacgaggtcggcttcgactggcgagctgttgcaccttcctacaccaagatgctggcctctggacagggcgccggaatggacaaagatgttgttgacagcatcttccgttccatgacagagtatggtaccgtaatgggcttggataccgagtccatgaaaggttctttgcgcgccgtcgaacagatgatgaacaaagaacaggtgatgtctgaggaactgaagctccagttgggtgaacggttcccggcagctatgagcctcatggcccaggctgtttctgcgaaagaaggcagagagattagcaccaaagaactcggtgatatgatggcgaaggggttggtccgaacggacgtgcttcccgagttcgctcgtatcattgccgagaaggcccgagaaggcggtgcgttgtccagggcgcagaactccactgctgcccaacagcagcgctttaacaacgcctggtcggacgctgtggggctgatctacaacaacggcatgggccagggcatggccaacctgttcaaggagatggctcggacgctgaacgataacgaggaggctgtaaaaggcctgggtgctgcgatggagtggctcctttccccgtttgaggcagccgctatcttgattcgtcagatgctgcaacaactacccgacctggccagcaagctgggactgacatctggacagttgatggctttggctggagctatcggccttgcgctattcccgttggggcagattgccttggctattggcggcctgttcctggtggtcgaggatttcgtcggcttcctgcaagggaaggatagcgtaattggcgacttcttcaaccaactgacgccagaacagcaagctgtgtggctgaagatcggtggggcagtagtccagacagcagaggcggttggtcgcctggctgaagccatgggagagctgctgggagggttcgctgagggtggtatgttctccactgcgctggacttcttcacgtcgaagattctggccgtgctgacagtcatcaccaagctggttcaggctgctgaagccctgaagaataaggattttggcaaggctgcgaagcttgctggagacgccggggccgtagcgctgtcgaacagcccggtaaccatgctcctccgtgatgacctccggcaggaccttgaggcccgagcccgacgtgctcagaatgatatggggcggaacatagatgaagacgttgttcgccgagtccctgagtacctcaaagcggagaacggggtgggtggtatgcccagtgtagggcagattaccctgaacatccccatccagattgagagcgctcctcaaatccgggatgaaaaggagttcagcgagatgcttcaaacccgaatcatggacagcttccatgacactcttcgccaggccatggtggatgcatcggagaacaagaaatgacggtagctattcaacgagagtccggggatatcatctggttcgatgcgattctgaacctgaacatctcccgggctaaccaggtgactcagcacgtggtagaatcgggagcttcggttaccgaccatgtgattgctcagaatcagaagatgaccctttcgggggtcgtctctgacgctgacttcaacctggacaggccagttattacggctgctgacgcacaggctttcgggatcacccctaagccttttgtcaatagtacgccagtgacatcgggccccatcatcaccccgggggcagacacggcctggacgaacttcctcccggagacggtcaaccagttcttggacctggacaggcccaccgtggtggttccagcggctcccaaggagaagggggcaaacctgatccgagaagaactggacaggatcaccagggaccgtgagaggattgtcctgctggacttcgaaggctctgctgtgaggaccatcttccagaacgtggtgatcacctcgatcagcttcaaggaagacccgcagagcggtgagtcattgtatgtggacctggcatttgaggtgatcaggacaaccaccttccagacggcagccattcctaagaaggtgagcgattcgataaagaacaaggccagcgagaagcaggccaagggcaagcaagccccgaaagatgagaaggtaacggatgcagacgggaagaacccgaaaggggaaaccgtattgcacaggatgactaaccgggaggtgcgatagtggctatccgagagcgggccaggctggtggagctacccacttaccgagacccacaatacgcctaccaaatgaagctgggggaccaaatccggtacctcagcttttcttggtcggataggcaacgatattggcacatgaccgtagaaaacatggacggagaggttatcattcggaacatgaagttggttccgaactaccctctaggctatgactacggatgggccaggtacgggctgaacgggtattttctagttctccccgacaaccacaagaacgacatctgtgaagatatctctactctcaacgagttcttcgaactgtactacgtggagattgaggaatacgacgatagcgaggaggtgtaaatggaacagttcgaacgggtgtacttgctcaccgttggagattaccggacaggcaagggagtcctgatcaaggatgtacacatgcggttcgacatcagcaagtcggcagacaacaagaagaagtccaacagtgccacggtcgaactgtacaacctctcagcaagcacccgagcaatgcttgatacggactatttgtcggtcaaactggaagtagggtatacggcagccggaacccgggtggtactggagggcaacgtggttgaacgccggactgcccagcagggccctgacatggtgactcagctcatcctcggcgaggggtacaccgacctaaaccacatccggctcaagcagacgattcctccggggcagactgccaaggatgtcattgaagctgctatggggcaactacccggcgtggtacggggtgttttttcagggaccaatatcaacaaccccgtggtgttcgggtatcccatggacgggagtgcaaaggaaatcttgaacgacatttgcagggacaacaacatggagtggcggtgtgatgcaggcgccctctacgtcaacgatgtcaacgggattcacgacaaaaacatcaagtcggccccggtactgaacgaatctaccggcctgatcggcatcccctaccggacatcctctgaaggtaaccggcagaagggagacaagaggcggacgcaaggggttcaattcaaagccctgttgaacgccgactttgctcctgggcaagtggtccgtatcgagtcaaaagaagtgacaggctggtatcggatcaactcagccaggtactacgggggctacgatgaccaggaatggtacgttgattgcttctgtggcatcattatcgaggaagacctcagatgattgaactaagtttcagcagcgtggtgaacacgctgatcgagcaacaactgaacaatgtgagaacagccatcccgggaagggtcatccgagtctacaaagacctggagacgctgatgattgatgctcagcccctagttaaccggctgtacgatgacgggacttcagaggagcagcctaccattctttctgtgcctgtgcaaatgccgggaactcgaaggaccttggtcagcttccccttgttccccggagatgaggttctactggtcttctgcgagcgaggcattgataactttaaagccggtaccgggaaccccaccaagcccacggggtctcgaactttcagtggacgtgatgctgtggctattcctggggtcttccccttcgcagtcagccccaataaccctgcacacaggaagtttcctcacagcacctacgacctggtggtagcccacaacctggccaccgcaactgagtgcgaggtgaggctgaaggagaatgggaacatcgaactcctgacggacctagacgtgaacgtcaaggcccggaacatcaccttggaagggtcagaagggattaccctgaacacaccggccctgaaagtccaggcacagaataccacctggacagggaacatcacccactctggaaactacacccagacaggtgtatcgacattcaacggcattccgttccacacccacgtgcatggaggggttatgcctggcggtggtactactgccgtcccacaagcgtgagggattatggaccttctactggatgaaaatagtcacgacatcgtgttcgtgaatgggcaaacccctgtgactcaggggcaagtccagattgtagctcaaaggctcaaaatcaagctctggacgttcctgggtgagtggttcttgaacctggacgtaggggtgccctaccgccaaagaatcctcaccaaggtggcccacaaggcgacggtggacatcatctttcaacgcctcttggctgaggatgagggggtgaaggaaatcctggaatatcgaagcgaatacaacgcgcctgctcggcgcttcaccttagaattcaaagtgcggacttactccaacgaagaagtagccgtgcgactgccgctggaggtataaatggctggattgactgacaaagggctggaaatccggtaccttcctgaggtactggagcagtaccacaaccgagcccaggacatcttctctgacgaagttgaacctggtgatgtagtagataccagtgagaactctaccctgggccgcatgattggcgtagtagccccaagcgtggctgagctgtgggaagccctgcaagaggtgcatgatagtttcaaccccaacgtggcgaccggctacgctctggataacgaagttgctctctcgggtatcatccgatacgctgaagagcccaccagggctcaagtagtgtttgagggtaactacaacatcgtggtcagctcggtgggctctgtatcctccagcgtcaccttgaggcagttccgggtgattaccccggtattgatgaaccttcaacaggcttcaggggtagcctggagggtcacggctgtcgaagcgggacacgagtataagatcggttactcgacggacggtggcagcaactttgtatatgccacgtataccgcgacacccacggacactgcaacgtctattcagaccatgctgggtcaaaaggtatcgcagtcgtggaccagcttcgaaacacagactgatgccaagaacaactacaactgggctcgtcgcaggaatcgtctacagattgtccacttcgacctggacccccgcatcaccccaatcaaggtggccaaacccggggcggtagaggatacccaaatgggcccatcgactcaacttccagggacgattgacaccatctcggtgccgatcctgggctgggattcggtgtacaacccgaccaatgccgtatccggcaggttcagggagacggatgtcgaactccgggaacgttggaggaattctaagttctaccaggccgctgccatcttggaagcgatgctggatggcatgcaccaagttcctggggtgcgagatgtgaccatcattgagaatgacaccaacaaccatgactcggtgcataacgttcctccccacgccttcacggtgatcactcatgggggtgacgactctgacatcggcaagatgatttggcagaagaagcctacaggtatccaagccttcggggacacggtggtgcagattgcggactcccagggcaaggttcactccattggattccgcagagccaaagagattgaggtccaggtcaacctaaacatctctgccattgcaggtcaggttcttcccggggatgtaaaggaacaggtcactgctgccatcctggcgtaccaagatgggctggacaaaattggtaaagaggtggtatactctagactatacactccgattaacagcgttccagggttccaggttaacagcttgaccattggaaagaaagggggcacccaggccatggcgaacatccctgtagggtatgacgaggtggctattttcgatgctacccgtattgcaatcacggtgacctgatatgctggaaaagaaccagttccggatgattgactttctgaaagtcgctcaaagccggtacacagagcaattcaagaagaagccgatcttcgataagttcgtagagctgcttcttcaggctcaaattgaactgcaagaggttatgcgccaggtccagcaagagcggaccctggacacagcagtaggggctcaattggacgttctgggggagattgtaggtctcccccggagtcttgtcactgccgagatattcaaattcttcggctacaaagaccgtcctgacaacccaaccccgctaccgaccccgggcaacgctggaccttacggttctttgaacgacccttcagtcggggcaccttggtggggtttggggcaagctactgagatttcccgggaggcaacggacgaagagtaccgcctgatgatcaaggcgaagattctgaagaaccggacgctatctaccccggaggatgtgatcgaagcctacaagttcctgtttggggctagccagatcatcatcgacgaactgggaaacgccaactgccgtatcggcatcgggaagattctttctaccgtggaaagaggtttgctgttcgagctgggcaacgtggccagcctgttgccgaagaccttgggtgtgaactacacctattcggaattctctgctgaccgcccgtttgccaccgaaggcttccagggaggttttggcacaggtgacctgaacgacccctcggtaggtggtattctgtcgaaccttctaacgtaagagagcaaaatggccaatatcaacaagatcagtatgaacctgatttggggcgtctctggtgatatcaccgccccaggtccggaaaagatgaacaagggctgggaggtggaggtagttccccggcaatggttgaactacctgcaaaaccggttggacaccaacgtggcctacctgctccagaagggcttgcctgagtgggacagtgagaccgagtatcaggcaaacacctcctatgtacaacgcaacggtgtagtgtacaaggcctctcggacaaataccaacagtgagcctggcacgactgcgggaaacaccaactggaaccgggctttccaagagtggtctccagctctggagtccttgacggcgcttaccccgactgcgtggagattcccgttctacaacgcttcaggacaagcaaccctgggtggaatcacctcctacactgtagggcttatgggtcttagctccgatgtagcctggcgggcagagctgaaagctcaagcgagtgcttcccagctcacgtggctgtccaacctggcacctgtagctggagctatcccgtatttcaatacggctacctccatggccaacctggcaacgaccccgtttggtcgaaactggatcggcgtagcagatgccgcaacgggtaggtcgcagcttcaactcggcagcgctgctgtcatgacggccacggctattaatcaggcgagcacagttgttgccagggattctacaggaactgccgccatcgggacggtgattggtagcctgaccggtaacgcttcaactgcgactcgactgcaaaccgggagaaacatcaacggtgtcctttttgacggaacccaggatatcacgctcccacctctgacagccgattacgcaggtacagtggcccgcctccacatcaacggggcgaacatgtcagggactgataaaacaacccagttggcactccgaaacaagtctaacacggattggatcagtctggctgtaatagaagataacatccttcagtttgctttccgaaacacttcgaaccccatcgtacagattgggggagaagtcgttctccacacagggaaccagttctcccttggaccaaccctaagcgatgcccgtagtcgtctaggacttgaccgagtgtcccaagggtcatccgataccgtggtattctctagcacgttgaataacggtccgtatttgaccgtccaaccttcctctgttggaggttttaatgggggaacgcagacttggatgttccgattcgatgaaactgggacactgacccacgggacggtaccagttgcaagagtgtccggcctggcaaactctgctcagattcctgccgtaactgctgcccagtctaactccttggttcaaagggattcaagcgggagctttagtgcggtaagcatcaacgcctacggaagcattgtcgggtatggatcgaacattttcagccgctcctctggtacagggaatgcccacatcggtttccagaaggcagatgggagtgagttgggcctgatttggggtgctccgtccaacgggtccatgaacttccggacgctgggtggctcgacaggcatgactcttacaggtcaagacttgactgtagctggaagggtcaacgcagccacgctcaacgcctccggaaacgctaacgtttcaggcaacgtgaacgtgggaagtgctaccctcaatacggcaggtaacatcacgggtcctgcctacggggcgtacaattccctgaccaactgggtggattcggtatatgccaagaagggtgagattcctaacgacattgcccgagctggagcagcctgggacgccgtagggcagtacatcctggcaggagaccagtcaggcgggtcgggaggccctggcaccattagggcagggagccaactgaaaccgcactctaccatcagttacaccgcaggggcacttccggcagccgggcagtaccgttgcatgggagcgtttgcagggggtggtaaccagatcaccctgtggcaacgcatttcctaaccaaacaaggggcttcggccccttacttctacctggaaggtgaggatgaaattcagaaacgttgtaaagtataagatggggtatgagtgtgagattaaacacccggaatgggggtggtcaccgtacttcgcctgcgactacgacgagaatgctaaaaagatttatgacgccattgtgtctgccattgaggcgggtgacatcccagtcccggaagatgtgtctgaccgggatttggtcattgatgcccgtaactggagagataatgaactacgagatgcagatcgtcaagtagaaatggccatagacgatgaagatgcggtcaaagagaaggcctggcgaaagtatcgctcagctctgagaaagtggcctgaaaaggcgggattcccttccgcaaagagccgcccgcgccgccccaagaattgaggaaagattatgccgcttccaaaacctgacgacctgtccgtgatctgggcatctattgggcaggcgaccaagcctgctccaaacaagatcatgacaggttggaccaacgaaatccctccctaccagtggcacaactggtatttccagagggtagataaggccctggctcacattaaccagcaaggcatcgccatgtgggatgctgccaccacttacgaagggggcaccagcctggccaaagggtcagacggaatggtgtacaaggccaaacggtccagccgaggtgttgacccagtatctccggcaagcaacctggactgggaacccgcattcgagaggtacggtgaggctgcgaaagtaaattctcagcttcaatccttgaaaaaggattatgaaacactggccaatatcagcaacattgccatggccaggcaaaacctctcggtatattccaaagccgagacggatgtccgatatgccttcaaggctggggcagccgggcaggtgtttgctgtagcccctgccaccgcagggagccatgcagtaccaagggatcagttgccatccttgtacccccgagcaggcgcggcgccgggtattatcgccctggcaagccaagcggaaggatacgcaggcaccgttgagaacaaggcgattgcaccgagtgtcctgaaagcactcaccctgtataagagccagaatctggcggacctcccggataagcagcttgcccgggcgaacctgggcctggccagctctgctgtgttgccggaaaacacctggttgaaaactgctagcaacctggctgatgtccccaacaaagccgcagcccgtgccaacttggggatcacgtcttcagcgctcctccccgagagcacctggttgaaaactgctagcaacctggctgatgttcctaacaagcccgcagcacgggctaacctggagatcacagacactgctacgctgccggttggcgacgtgatgcgtaagagtcagaacctggcagggttgaccaacgttcctcaagcccgtgccaacttgggtttggggactatggcaactgccaactcgggagacttcctaacctcggcgaacaaccttggagatgtcagggatgcacaagcagcccggaacaacctgggcttgaaaggatgtgctactctggacgctctgggtctaccgaacggagcaactggcctagacttccaatcggaacaatcctccagcgcatccggctgggcagctcttccgaacgggttgatccttcagtggggtcaaggccctgcactgtacgatgatcggtctacgattgtccggctgccacgccaggctcgaatcctgaacgtgagcgtaactgtgatgggcactttcaacgcctctatcgggcctggcgcctacatgacggaccagtggagtaatactcagttccgtgtatcgtgcaactggggcaactgggcgtatccgttctgctggttcgctatcaccaccatctacgggatgtagtatgatcaccgacagagagtatcagcaagctgctgagatgttgggggtagatgtcccagcgatcaaggcagtgaccaaggtggaggccccggtagggggcttccagcctacaggagagccaacgatcctctacgagcgtcaccagatgtaccgacagctccaggccaaagggctcccaacggaaggtcatcccccagacctggtaaataaggtagctggtgggtatggaaaatacagcgagcaacacgctaaactggcccgcgccgtaaagatcgacagggacagcgccctggagtcctgctcctgggggatgttccagatcatgggctaccactggaagctgatggggtaccctacccttcaagctttcgtaaacgccatgtacgccagcgaaggagcccagatggacgccttctgccggttcatcaaggcacaacccaccacgcatgctgccttgaaagcccatgattgggccaagtttgccagactgtacaacggtccaggctacgccaagaacaagtatgacgtgaaattggagaaagcatatgctgaagctagtggctgaaaaggccaagctgcaccgtagcagtacagtggtgctgagcatcttcctcttcatcctctcgatgctgatcatcttcgagccgctgattcccgggcttgcaggtgttctcggtcccgacctataccccaaggtcgtggcaggcgtctccatgctgattgcagcaggccggtacatcgtccaaacctccctccggggcatggtagttcaagtatcggatgagattcccaaggaggaagaggaaaaatgaaactgatgactgccatgcggatagcgttggtagtcctcgttctggggctctcctggcttctccgggagagtcatcagaaaatcgacaggctggagcagagcctggcttctctggaggccagctacgcagaagcatcggcatcgtaccgatccttccgaaagcaatgtctgtccgtgttctcaatgaacgaggaactggtgattcaaaacaagaccctggaggcctctgtgggctccgtggtacaacgtttggatcggacccctacactgaccctacccgaggtgaaagatgcgcctacgagcgttcctgggcatgtggctgctgagcgtctctctcctgggactatggagttgctcaacgaagccttctgtgccgcagcccccgcaggtcatcctgcctgtgctcccaaatgagtggacaaccccctgcgtaatcttcccggtggaagaggacacggtaaaggccttggccaaggggtacgtcctgaacactggtgcagcaggttgcgccaacaacaaactccacttcatccagcagtggtacaaagacctggaggcccagtatggcagccgcacgcagtaacaacgaagactcccagtggaagtatgtactggacctggcagcaaagttcctcctacccctgctgatggcatgggccacctggcaacagacgcagattggtaaggtagaggataggctgtatgccctccaagctgttgctgtgaccgagcaaaaactggttgccacggaaagccgtatcctgaactacctggatgttcggctaggggacctggacaagaagatggaggtcaatcagaaatactccgaaatgatcatccagatgatgaagcaggagcggtaaacgagaggtgtcctcatgacgaaggcccacgaaatcaccgtcctggggatgctcttcgctacactgctgactctggtggtcggtttgggagttctggtctactacgctcaacgagtgaccagcaccgagtaccagttcgacatcatccggaaggagtaccggctcagcctggaagagatgcggcgagacttcgatatccgaacaaacagactgcaagagcaaatcaatgccatgcagtataccacgtctaagcagatgcggctgcttcaagaagagcaggacaacctcaagcggaaaagatgagccccactggccacaagctggtggggctttttcacgcccggagaaaagtagttgacatcccccacaacaccctatacagtggccacatcaacagcttgaggaggttccatggataaggtttacatcgacgcaacatttgacattgaatcggtgatcaccgagccggatgggatagtatactcggactaccacaaaggaactcccttaggagtaaccgccactctccgtgtgaacatgcccaaacgggactcccgcagggtgtggaagactctcttggccatggatttctcggccctggagcagcgtgtattggcagccatgctgacttctggagggttggttatgcttctagaggatggtaagctgtacgatcagaacggcgcccaggtagaggacccccgtgataagctcgtggtgatcttcgatgagtgggacaagctttccaaaaatcagcgccacctgcgcgccaagaagcaccgtacagcccccaagaaccctcaactgcgaaagaatcactggaaccgttgacacaggaatataaaggaggaacaatgaagaacagtacagcagccctcggactggcatgtgctctggcgacgatgctcgccctgccatccccgtaccctgctacgctgaacagccggtgggaggttgaagtcccggcccaggaggaatcgaccgacaagaagaaggccaagaaaaagaaactgaaggcccttcaagctgaagctgttaagtcgcgtaagggaggtaagaagtgactaaaccgctcgatccgcctccgacagtggagtatgttcgaacgactcggaaggaccctccaccgcctcctccaggccctgctgtgaggtgggtgaaagaagggacgactttggatgaactagcgagggatttgaaattgcaacatatgaaagcatggtctgtcgtggttttagcagttatcctggcactcaccatgatgttttccttcctgggcatgatgcagcgcttggaagagaaccaagtgaagctcgaatctgagcgggtgcaagccgtgaaagaggcaatcaccaaatgcgaggcgggagctggagtgttggaagtgactctgaaaggagaccggctgacttcctacacttgcaagttctcgaagtagctgttatgattccagacctcaaggaggcttaccagaaagcctccaagaggactaagctgttgatactggctgccctggttagccaagcagcgatagccctctacgaacaagatagaaggtctttaaaagacccccacctgtccaggatgtgtttcgtacaacaaggggtttttgaagttacccgaacaggccctatcacccgaatctattgcaagaaaggagagtaaagatggtaattttcactaaagaacggaacaacttggccaacagtgagatgatcgctatcaacgccaaacacgtcactgctctggaaatcccagcgtcgaaggaggaaatccgggtaggcctcacaagcggggttattatcctggacttcctcaccgcccaggatgctaaacaagccttcgaaactctgactttcgcctgctaaggaggtaccaatggaactcgacatccgccaacccaacccgcccttcgataccatccggattgcggatatcagcgatgatatgagcaatgtgtgcctgatcacgtgcaaagaggcccctcccggagctgtgcgcttggtgtacccggacgaaggccaggccacattcggaatgccaggagatatcgttcatcaagagcttttggtggaggacaagatgcacgccaacttccttatcatggcgctggagaaggctatcgagttggggtggctgaaatgatgggactgccgatctacctgagcgttagcgtctaccacttggcaggccttatcgcagtctcctgcctggtctactggggtatcatcaagatgacccggagcgaggttgaacgaggaaacatgaccaagccgcaagcgtcctggtggcgtaagtggtaccccgtgtgggctatcgtctgcatctcggtatcgtgcctgggcttcggctacaaggtggaagagattcgcccggtgggcacgttccaatcccatcccacaactgttgacacaggggagaaggaggagtatcgtgcataccgtgaaaaggcagaagagcggttcaacaagacccttgaagccatcgaaacgaaaaacaacctgaagtaaggaggaaagatgttcaagaacctgatgcgtggcgtcgccattgtcctggccctggccctggttgcaggctgctctgatgtggtaccgcctgccatgaaaggcaagcacctcagcggtagtggctacagcaccaatgtcctcgaacctggccgtcactggcgtgccccgtggactcgtatcgtgatgctggatgtctccacccagaccgtcgccgagcccctgaaagtgaagatggccgacaatctggacctgacgttcgtggtacgcttccgtactcgaatcgcaggcaccgagcgaaccatcaatgccatgttcaacgatatccgggtggagaatgaccgagtaactctccagcaggtgtatggagtctacggtaaggatgtggtacaacgtgtcagccgctcggtcctgggcaagtaccgcacccaggatgtggcagccaacttcgacaagatcaaccaagccctacactcccaactggtagcagcaatggagggtagccctttggaggtgagcaacatcacattggctgacctgcaatacccggaagtgatcacgaaggctatcgaagctcagaacgagcgagagctggctatcaagaccgccgagaacgaacaagctatcgagatggtcaagcgtgagaactccctgaagctggcccaagcggatcgtgaaatcgaactgaccaaggcacgtactctggctgaccagaacgaaatcacgaaccgtggcctgtcggagcggctgctccagtacaaggcgctggaagtccagatggaaatgaccaagaattcctctgcggtgttcgtaccctacgaggctctgaccagccccggcttccagaaccgcgtctacaagtgaccaacaggggccagccaggctggccccatttcttttgaaggaggatgcatggaacataaagcgttggaaggtgttaaacacagaacgtgggaagtggtggatagcgagtttgacggagtttacattcgagaagccctccctaaagtgaggggtggatacctggtagagtacgtgattgcttccgatgttaaggaagagcatgctgctaccctgtgtgctgctcgggagctgaaagcggagctggagcgcctgtgccggatgagtgagtccagctttatccttttgggctgggaagaaaaggacattaagagcttcctcgctcccgcaaaagaagccctggccttggccaacaaaaactgggagaagtaagatggacgtgatggacgacgattttgagttccctgatatcctgcctgagtgggctgacgagtttcacccttcggaaggaaagcaccagataggggcccagttggcgactaaggatggacgagtcactgggaatggggtgatcttctgtgctgtgccgtggaaattctgccccgagctttacctattccttgtggtgacggatgcaggaaacgtcctcacgttgaccgaggccgagttgcacagcctcttccattggccacaatatatcgccgacctcaaccagaagacgccggctgaggtgatgtacaccgtcaaaacaggtccaatcggggaccttattcaagacttcaaggaggcaaacggatatgcgtaaactggcttcaattcgtcaagtgtcggggatcgaacccatcgctggggcagatcggattgagaaggccttcttcggaggctggaccaccatcgtcccgaaaggagtgctgttgcccggcgacctggctgtctacttcgagattgacagcctgctgccagtggcagacccggcgttctcccaccttaccaagaacctggtgaaggttacccggaagaaatcagcctgctccctgggtatggattgtgagatggcaggagtgtgttatgccgtgtcgcaaggctgccccagcgagtgtggaggcgaagaggaggtggtatactcccgactgcggaccatgaaaatgcgaggtgtcacctcacaaggcttggcccttcctctacgagccttcccaggccgcctggcccagttggaagctggcatccttcgccggctccagaaagcgcccgtgcaagaggtgttggacgatctgaacgagaagatgccgctggatgaaatgctcggtgtgctgaagtacgagaaacctgaagaggtggcggcagggaacagtaatgtctcccgtgtcagcacgttccctcgatacatcccgaagacggaccaggaacgggttcagaacatccctctggagaagatcatcgcagatgggccgtaccaggtgaccgtcaagatggatggctccagttgcactgtgtgggtaaatgaagacggtgttggcatggcaagccggaatcaaaccctggtggagcctacctggactgatttccccagtttcgaggattgcaaccactttggccaggctgtactggatcaggacattcctcgcaagttggcagagttctatgaactcagcaaacagccgttcgcaattcaaggcgaggtgtgtggcccggctatccagggcaacaaggagaaactggagaaacccaccttcttcttgttcagtgtcttcaacatcaaggagggtgcttacgagtccccagagtattgcaggatgctggcggaaactctcgatattcagcatgtgcctgtgctctcgacccggcatgtgtttgaagatgtcacttatgccgacatccttgccatggctgaaggtaagagctataatcctgccaccaacagggaaggccttgttttcacagcggtagacaagaaccgctacggtcactacccccatttcaaagctatcagccaatcttggctggcgaaacacgagtaaggagagtccatgcagtcccagttccaaaacatcctgaaatccctggaaatcgctcgccagattcgagacgatgaagagttcgcccgactggtcgagctgggcatggtacaggccgacatcatgaatgaatcgttctactgggttgacatgcaggggcgtttcaggcagtatactcctcacggcttcgaacactgaccaacatggcccggatcatccgggccttacaggaggaaacatgagcgaaatcaacgtttatcccagcattgctgagaatatttaccctggactgacccaggcggccaagatcgtcctgctgatgaccgttccggagcttcgaggagtcatctgccctgacacaggtgaacgtctgcgagaaggcctggggatgcatggtattctggagtgcgtatgggaaagccgccacaaggtccatgccatggaccaatgggccaacttcatgcaaggctacaagtccgaaatgcccggctccagcgacatgtatgaccagattcaaagtgtactcccagcccggaactccctgaaacacctgctgatgccgtacctggaagcttgcaaacgccaaacccgcgaagaacgcattgcgcaggagaagtaccgtgagcaaatttgaaatgcttgacctggtgtgcattcatccggacccggaagtgtctgggagcaagggcacgctattcggggaattccgggagaaaggtgccatcggtatcgtgttctacatccctcacgggatcagcacaacaggtaaggttaagaacctctgcaatgaaaaaggctacgggatagtctggcatgttgatgggcgccttcgcgttatgtacggcgtacccgaaactgacctggtaccctacaaaggccttcgccaggaggatgatttcccgtggtctgaactccctcttcctggggaagtcatcctcttccgcgaagaggggtatgtgaatggggtagacggcaatgccaagaaagcccagtatgacaccgttttaactggggcggtgtacggctactcctcagacatgaaacttctgctggtgtcggtactcccccacggagatgaagaggaggtacctgtagaaaacgtgatcggactgaggatgtccatcacagaccggatgccggaggagggatatcaataatggcaaagctgaagctggatggtaatatcctcaccgtaatggacctcacggcgggccaggccgtcgagaaggtgaagcaacgtatccgaatggatgttgactttacccaggtaactgtggtacagtctggtcctggagtcttccaagtgtcttaccctctgaaccagggggagcgtggaagctacaagcacctctatgacaagcaggagaaggagcgaaaggcgaacaacccgcctcccgagccaccacctctcctgctggcgtaaccctaaggggccctgattgggccctttttattgcagaaggagtaggaagtgctgattgggaagttcgcctgtgtcctgccaggatgtaatagcagcgacgctatggcggtctacgaggatgagcctggggtcttcggcggacgctgtttcagttgtgatcggatggtttcgaacaacaccctggcaaggtctcccctgggggaagagttgggagcagtgatcatcaaaggtgatcgacgtgcccatgcccagaggaggaaagaggagaaagaagtgagagagattcaacgtaagcccgtcatcactgccgaagaccgggagaaaatccaaggcaacggcggggctgacacgactttgttccggggcatagcccggcagaccaacgagaagtacgggtgtatcacgcactacgcagacaacgagcctgtggtgcggtattatccgatccacgaccatggtgagctggtaggatataaggttcgtcagattcccaagtccttctacgccatcggtcggaacgacaaacactgtgagctttatggtcaacacctgttccctgccggaggcaaatacctcctcattgtaggcggagaggaggatgctcatgcagcctaccagatgctccgagttgatcagctccagcgctggaagaagaagaacccttacgcggacatcgcagatgcaccgttgccgtatccagtcgtaagtccgactgtgggtgaaacctcggcagccagccagttggctgccaactatgagtacatcaactctttcgacgaaatcatcctcatgttcgacgcggatgagaagggagagcagggtgctcaggcggcgctggaagtgctgcccatggggaaggtacggattgccaacctcccagggaaggaccccaacaagatgttggaggacaagcaggccaaggcgttcatcaatgccttcttcgacgcccgcaaggcatccccggcaggcatcgtggggtcgggtcagattcgagaggctatgcttaacaaggcaatggcgcctaagctgcccctgccctcgttcctgtacgagctgtctcggaagaccgctggaggtttcccgctgaactccatcgtcaacctgatcgcaggctccggcataggtaagaccacctgggtcaacgaactggtgtaccattggattttcaacagtccttacaagatgggcatcgtcaccctggaggccgacattgcagagtacgggggttatctgctgtcccggcacctgggccagaagctggccttgattgaggaccctcaagagtacctggcaacaatcgaatctgacagggtagagcaggcgagtaacgagctgttcctcaacgctgatgggtctgaccggttcctgctggtggatgatcggggggaccacgatgcgatcaagcagaagattgagcagatgatcatttcggggggcatccaggtgatcgtccttgacccaatgtcagacctgattgacgggatggacacaggtgaacaggcgttgttcatgaagtggcagaagcagatggtgaaggcttacgacgtaatcttcatcaacgtcaaccacacccgtaagggcaaggacaacaagactgctgcaagccggggcgctgagctgagcgaggaagacatcattggctcctcgaccatctacaagtcgggcaacatcaacatcaccctggtgcgcaacaagcacgcggaggacgatttggaacggaacaccaccctggtgacccttaccaaatgccgccacacagggtacaccggaccagcgggtagggtcctgtataacatcaagacacacaccttgatttccctgacggatttcctcaaccagcaggtggaggagtacaaccaggaacatggagagtctgaagggttagagcaataccctgaagcagcgtgtgtcgagcaagttcattcgccggaagatgtggctcccgtctaccctcagttggacggcccaccgccgaccggggacgatgatattccgttctgacggatgaaaggaggagtaacgtggaagaggtacagaaacgccgggtagtattcgatatcgaggctaccgggctgatcggggaggggacggtggattacaccgcctcaccctggcgcctgaaagaggatttcaagctacactgtgctgtagctcgggacattgacaccgacgaggtgttcaagtggggtcctgacgaggtgatggacttcgccaaatggctgggtgaagagtgctcggtcgtaattggccacaacattatcaactacgacttgctggctctgaagctgacatgcgggctggagtacaccatcgggtggggagagaccaaggacaccatcaacggtaaccccgtcaagatcgtggacaccctggtaatctccaaaacccttaaccctgaccgtcgccctggccacggcattggggcctggggtgacaagctgggcctggccaagatcgattggcgtgcgaaggctgttgaactgggattgattaccgagaacgcccctcgtggtgcagagttcaagacgtatcacccggagatgctggagtacaacgtccgagacgtggatgtcaacctgctggtctacaaagctctgatggcagagtggggcgcctggaactgggccccagcagtccagaccgaaagctacgtggcttgggtggtgacccgtcaaagtcacagggggttcttcttcgacgagcgcctggcccaggccaacgtccgggagctggatcaactgatggaggagtgtcgtgccattgttgaaccgatccttcccccgaagaagccgaccaagacggaagctgccaagtattgcttcccgaagacccaggagaagaagatcaagggcggtctgggactctccagcaacatggagaagttcctggagaagatgggcggtaagcaccttccacgttcggggccggatgctcccaactacgtggaaatcaacggtaggacgtatggcctaccgttcgatcatacggtaagcttgctcactgaggtgcctgccaagatcagcgatacaacccacatcaagggttggctggtggacatgggatgggacccgacttcgtggaaggagcgtgatctttcgtcggatcagaagacgaaggcccagctacctttcgagaagttcgaaaaggtggtgacctcgtacatcgagcaaacctatgcaagcccgttcaagaagtaccgactggagcacctgaaagagaagctgcgtgctaagtggtccctggccttcatgatggacaacccagacatcgttctggagtacatcctggagcgaggcaatgaccggcagttgaaggtgtggaccaacccggagttcaccgtaggtcaggacaaggacctctgtcccgccctggaacgaatctccgagaagttccctcacgttcggcacgtgaccaactacctgacgtatcgccatcgtcggaactcgatcctgggtggtgggtatgacccggacgacctggacgaagatggcatgcctgtcaaggggtacatggcctatcagcgtgaagatggccggattgcaactccggcagacagttgtggtgctggtaccagccggttcaaacacaaacaggtggccaacattcctcgtgtgacctcgctgtacggggtaccgatgcgaaacctgttcggcgtggacaccaacaagtgttggcagattggctacgactttgactccctggaagcgaagattgaagcccactactgcctgagcacggcaatgcgtctcagccctgctgcggcacagaagctcaagatcaagtttgggtccaacttcgccaagtaccgggaagcatgcatccaggcagcgcaagagtatgcggtagcgcttgtggctgagaagcccaacgatattcacacggtgacggcggcgaagatttccaccatcatcggaggagacttcagccgtaccaatgccaagtcggtcaagtatggctgctcctacggggctcaggtggctcgtgtagcgaagatcgtcggctgctctatgcaggaggcccaggccatcttcgacgccttctgggaggctgctagcccccttgcgctgctgaagacggttctcaccgacttctggaaggagaaggggaacaagaagttcatcgttgggatcgatggccgtcagattccgactcgctctgaacatgccctggttaacagcctgttccagtcggcgggtgttatctgtgccaaggtggcgatgatcatgcacgaccagaagctgatggctgaaggtctgctggtagacttctggaaggatgattggaagaataagtcgtattgccagcagctcattgcgtaccacgatgagagccagttggaagtgaccaaggatttggtcaagttcaagatgttctcgaaggaagccttgggctggcaagagattcagcacgaggacccggaggagcagaagaagcttcagaagaaggaagacgcccgatgcaaggccctggtccagcagtggaaggacgagatggaagagtcctcgggtcaaatctggagcgatatcggagagtccccgaagggcggttggttcgtaggctacagtcgggcaggggagacggctatcgaggctgtcaaagctgctggtgagcacttcaatctgcgagtagacctgtccgcagggtacatgttgggaaccacgtggggcacctgccactaaggtgcctggaggagatatgagcaagaaaggcaataccgcaccaacaggtgtggctatcatggattacgtggacatgcgccaccaggagttggaggacttcctcctctactggacagagaaccacgccaagggtagggacttccctttggagatgcccaacgatgcggagtggtttgaacaggagttggcctacctgacggtgcaaggtatccgagagacttgacattgccatcggattgtgcttcaataggctcctcgttgcaataatgcgcggggagctatcaaccagaagtatgcaagtttttgataaaagtccttgactttcaatagcttatatgcttcaatagcgttccaaatgaggaggacatcatgtctattcaggtagaggagaccacggaatatgtggtctgcaacaagtacgatctgaccagccggtcctacgccttcagccttcgggaagacgcccggaagatgaaagctcaactgggtggcaagcagttagggtggatcatcgagcgaattactcgcaagattgtcaccgaagaagttcgctaacaagcgacaaaccccccgattaggggcaactaccgcccgatagggtaattgataggagaagtaaaacatggcactgcgtcccaaaagcactggcaacaccggcaccccgcgtgagttcgtcaacctccccgagccgaccccgggtaaccacgaagcccgcgtctcgctgatcgtctacctgggcgagcaaaaccgggaagacttcgttgatgagaacggtgagagcaaagctcagaagcctgtggatcaggtggcagtattcgcagacctggtggaagaagtagtggactacggtggtgacatcggtgagcaacagtaccgcctgatgctgaacaagtccttccgtggtgaagtgagtggtatcaccctccaggcgaccccgccgcgtgacggcgaaggccgtatcgtcgaaggtggcatctggacctaccacccgaacagcccgctgaccaagctggcgaaagcaatgcaaccgggtgcagcaaccgcgatcctggacggtaccgacctggatatcgagccgctgctcaaccagccgttcatgtgcaccgtgaacgtcaagaagaccccggcgaagaacgacaagaaggacaaagacggcaacccgctcgtctataccaacgtcagcttcggtggcgcgacccaggtcccggccaagatgatgcgtgcaggtgtggctgagcttcgtcagaagccgctcctgatcgacttcgacaacgtgactatcgagaccgcccgcctgctccgccgcgatgtgattcgcaagattcagcaggctaacaacctggctggcacccgcatggaagccgttctccgtgaactggccaaggaacgcggagacaaggtaccggaagccaaagaagctcccgcaccgcgccccgtagcaacccagcagagcgctcccccagctcagggtcctgcttcggacgtggacagcttcgacgacgatattccgttctaagacggaaccctcagggcccttcggggccctttcttttactccaaaggaggagatgagaatggaagattacgtggtgatcaagtgccgcgttaacactggtttcgcaggcggtgttcatgaagatgaagagcacatgccacgagacgagtgggaagagatgtcagagaaagagagggagcggttcctggaggggttcgcccaggacatggtaagcaactacatcgatgcccacgcgtgggtggaggaagagtaaatggcacagaacaacactctcgttgtgaatgaccagcacaacgtcttcgtcctacggctgccgcaggcctattttggccatgacattccggtagccatgaaagaggatttccagtattggaaagagcagctacatcttattgctcaaggctccaaaagcacgctgatgattcccagcacaactgacccggaatctcgtcagccgctgttcgacttccaaatcctgcctcggaaaactgagcaggtttcccccagcaccatcaacatccagaactgaaggagagagaaatggaaaactacaacgacgagcgtgaaggtcagatgaccgagaaggaactgttcgaccgcctggtgactctgcaccgtgaaaagctgaccaacgcagaagaccgttcgcagctcaagaaggatgccaaggagcacggcctggacaaggaccgtatcaagctgatcgacaaggcagcagcccacgacgcgaagcgcgacttcgaggagaaagactatgagttctcccagcttcgtcaggtttacgaggaactctcggaggacgcataatgtcccagccggcaaacacaattgccgtaatcgacggtgacgagtgggcctttaaggcctgctctgccgccgaggggcgtgctatcatagcgaagcacatccccagcggcagggagaaggagttcaaccatcgcacggaattccgagacttcctgaagacccagcacggtgggaagttcactgaggatcagttcgaaattcgggatgtccagtaccctgagcccatcgagaacgtcctgttcactctcaagcagatgattgccggggtgtgtgctgaggtgaatgccacgggctaccagattctgatttcgggcccggacaacttccgactcgacatcgaccttcccaagcgctaccgcacccctccaaacaagcgagcgccgaacggcactgagaaggcgggacgctacaaagagtcccggggggattccctccgtccggtacacctgagcgacgccaagaagtacctgatcaaaaagcacggggcactgaccacttaccgttgcgaggccgacgatgctctggcaacccgagggtacgccgggcgtattgccgagctgaagggtgctgctcagtggatcatcccctgcacacaggacaaggatgcgatgggtgtggagagtcgtctctacaaccccaacaagcctggcctgggcatcatggataacatggggtttggccagctcgtcgagatgggtaaggatatcaaggggcatggtcggatgtggctgtacttacagattctcctgggagacagtacggacaactacaacccccgtgacatcctggagtgggccacctaccaggccggaggcactccaaagccctttggggagaagaaggtctactctgtcctgaaggattgccaggacgaccgggatgcctggaaggcaatgtacgaccaatacaagctctggtatccggaggaagtggagtacgttagctggaccgacgaggttatgcgaaaggacgccattgacatcatgcagatgtacgtggactgcgcccacatgcagcgttgggaaaacgaccgaatcaatgtccggcagacgctggagaaaatgggagtgatagaatgcagcaagtaagccttacagattggctggaagagttggacctggttctcgaaagtcgcggcctgccgtcagcccatgcgtacttcctggaaggcctgtacggggactactacgaccaaggcctgacccccgaggaggcagtcgaagaggagttcggctgatggagacggtcaccgagaaaggcaagttgtgggggtggttcccccacctgtacttcgttcgggcgggtgtcatctgcgtgatccaactaggacccctgaagctgtccaaggtgggggctgtctacggcatgggcctgttcaaccggctgttgttccagtggggtgggagatgagtgttcgtcgccgaccctgggaagagcttccagaggtttggaagactgaggcttcattcctgtcctggctgcgaggaggtatccgtcgcgccatgtggatgaggcacccggtcaagctggagttcatcaagaacaactctgtggagatggtgaacaccaaccctcgaagcatgaagcggttcccaaccgtaaaaggcgcccagtgctccaaatgtggagaggtgaagcgtgcagcggacatggaagtcgatcaccggacaggggagttcagccttcgatctatcgaggacctgcaaaggttcatcgaaggtgtggtgctggtaggcatggacgacctggcatggctttgtaagccgtgccatgaaatcaagactcacatggagcggcaaggtttccatacctggggagaagcccaagctgacaaggaagccatcgccattggcaagaaaggcgtaaatgttgtcaaggcatggctgaaagagcgaggggtagagcctggcaccacagcggctaagcgtcgggatcaaatcttcgccatcctgaaggaggagtacaaatgacccaacggtgcatgttccggcaggatgattcctgccactggtacctggtcccggaagcagagtgcaggcggttcgatgagctgtgtgccctgatcaccggggaattagagccggactcggaagagtggtttgacgccatctgcgagttcgacaacagctatggccacctccgttgtggtcacccgtccaattacgtcatcacggcgcactaaggagatttcatgaaaccgtggcacaataccgctctagaactggcagcagccgggaagtcctggcgtcagattgccgtggagctgggcatggccaagtccactgtgagcgacttcctacgaactcagaagatcaacgagaacaagccgatgcccaaggtgctgatcctcgacatcgagacggctccggctatcggctattactggagccgctggaagaccacagtgggccagaaccaggtgttgcaagaaggttatttgctcaccttctcggccaagtggctgggcagcgatgatatcctggagtgcaagcttccggatttcgacctgtacaacaccgagccgaagaatgaccgagagcttctcaaggtcctggcaggcctgctggatgaggcagacttcgtggtggcgcacaatggccgcaagttcgacctgccgacgatcaatgctcacctggtgaagcacgatatcttgcctcccagcccgtacaagatcatcgacacgtgcgacattgccaagaaggtgttcaagttcccgagcaactctctgaagtccctggcgattttcctgaagtgtcagcacgataagctggatactggcggtttcgagctgtgggcgagagtcatggatggagaccccaaggcttgggaccgcatgatggagtacaacgtcttcgacgtgattgtcctggaggaggtttacttgaagctgcgtgcgtggtataatacccacccgtcgctctctgcgttgatccctcagaaggtcactcctcattgccctgtgtgctgctcggacgacttgcgtccaacgggtaaactgtactacaccgcagtgtcggccttcgaggttctccgctgccatagttgtgggaagcactcccgcactcgtcagaatgtcttggaccgggaacacctggtagtcggcatctgattcaaagcccaccttcgggtgggctctttcatatctacaaggagaattcacgcatgatcatgagcgatctgctcgacgccccagagaagcccgaaaccaccgagatggaagtgtccatcgatcaggagctgggggctgacctgctgatgtggttggaaaagaactaccccgacaccccgatgatcactgtgtatgtcactctgctggctgccacgcagatgattgccgaaactatgaaggtggcctccacctccctggacgaaggagtcaagctgtgaaactgggaccctctgtaatgatcactgccagcgagtatgtcgcttccaaagaagcggcagagatgttcaaaacccttggaagcccgtctggatgggtaaaccctgtagcccctgccgaagaggagggggaacacacgggaggttcttccagctactaccaagtggaggtgcgtaatcccacctctggaggagaaccgtacatcggggagtgcaacgattttatcgaggcactagacatgaccttcgccgaagcgaacgtgttcaaggcaatctggcgaaaagcagccgagcgcaccctgggtaagaaaaagaagggcaacaacgctgtctatgatgccgagaagatggtattcttctctcaacgggagctgattcagacccgtgccaaagcagaaacgaagaaggagtaaccaatgaaagcgagcgtgatcgccaaaagcatttcctatccaggtacatcacagttcccggtaacaatcaccaccttcgagctggagtatccccggttcatccacgccgagctgatgacgcaccacgctctcttcaagaactgtgcctccagccgggctatccccaccaagaagctcattgagcaggtgcggaataacccagctatgccagtccattggggtgctaaccaggccggcatgcaagctcacaaggagctgtcgaagcctcttcaggtggcagccaagtatctctggatcaaagctgccaaggccgccgctggaatggccctggctatgcacaaggttggactgcacaagcagattgtcaaccgggtgcttgaacctttccagatgatgaagacggtagtgaccgccaccgagtgggagaacttctactggctccgtgatcacgaagacgcccagccggagttccaacacctggctcgaatgatgaagaaggccactgccggggtggcccctgaattactggtccctggtcaatggcacgttccctatgtgaaaacggagttcatcccgggcctgggccggcaatacttcgatgagaacggagagataatctctgtagagcaagcgttgaagctttctgcaagctgctgtgctcagaccagctaccgggccactgacaagagccaggacaaggctgaagtggtcttcggcaagctgatcaatagcgagccagttcacgccagtcctaccgagcaccaggccacccccatgcatatagcaggtggctgggagaagggtgtgactcaccaggaccgtgatggttgttactggtcctccggcctgagaggttggattcagcatcgtcaactaattccgaacaattgcaagaaggggtaaactgtgagtcaaggtaaggtcgagttttcgctgtccgtgtcggacctgcgactggtaactggtttcaaagaggcgttcgctgcttaccaggcaggtaaccccaaggtcttggcagccctgctgtaccgcaacggcatggacaccacacagccctacgaagtggttcaccgggaacaccggaaccttcgtgggcaacatatctccggcgaacgtttcgaaggctatgagcgactggacgagagctggatcaagaagggggcaccgagcgaggaggcaatcatcgcctctgccaaggacggtagcctccgtgacgagctgatccacatgggtcggcgactaaaccctgcacaggctatggtggatttcctgaatgagtgagagtgttcagccgtataacggcattctgattgattattccctggaccggacgatcccggaacaaggattggcgatgctcacctcggacggcttctacaagaaggaacacgagacatcgcctcaacaaacgctgtcacgagcagcggtgagctattgcttcggtgactacgattttgctcagcggatgtatggttatttcagccggcagtgggcagtgcctgcaagcccggtacaaaccaacgccctggacatcgagtggcccaatttcaccgaagagcagtttgacgaagcaggggactggcttcaagaaaacatcgataccaccgggatgcccatcagttgcttcctatcgatgatcgcggacagccgtaaaggcctcacaacggcctctggtgaagcgaaagagttgagcatggctggtggtggggtaggcgtctacgcaggcatcagggccccggatgagctgtctacgggcgtcattgagcacgctggggactacgatgtcatgtgccgggcttaccgtcagacccgtactcgtcgtggcagcatggccatgtacttggacgtggctcaccccgagttccctgtgttcctccaaatgcggaacccggtaggcggtgacccgaagctgaagcgcttcaacctgaacaacggtgctaacatcccggacgccttcatggaggcggtcatcaagggtgaggattgggagttcgttgatcccaaacacggtaagactggacgtaaggttccggcacgtgagctatgggaagagatgcttcaggttcgtaaggacacgggcgagccgttcatgttgttcgtggacacggtgaaccgtaacctaccggaatgcatcactcatccgctgtaccgggtacgacagagcaacctgtgctccgaaatcaccctgtacaccagcttcaagcgtactgcggtgtgctgcctgtcgagtgttaacctgggcacctacgatgagtggaaggacgaccccctgtttatcgcagacatggttaggttcctggacaacgtgctggagttcttcatccgcctggcacctccgagcatgcaccgggccgtacactccgcctccaaggagcgtgcaatcggcttgggaaccatgggcttccatactctgctacaacagcgtatgatcccgttcgaatctggtggtatgggcggcatgcagcagctcaactatcaggtttacaagcaaatcaaggagcaggccgtacaggccagcttggagctgggacgctcccgtggggaggctccggactgccagggaagcgggcgtcggaatagccacttgctggcgattgctccgaatgccaacagctccagcctggtcaacgtgtctccgtccactgaaccctgggcaggcaactgcttcaacgctcaaggccgggcggggagcttcctgatcaaaaacgaatacctccggcgagagctggaaaaagtcggcctggacaccaaggaaacctggcgttcgatcaacgatgctgaaggctcttgccagcacatcgaaggtttgagcgacgaggtgaaagcggtgttcaagacgatccgggagattagcccaatgtggttgattgaggcagcagcagggcgtcaacccttcatctgccagtctcagtcggtcaacttgtacgttcacccggacatcacgctgcaagagatgtcggacatccacatctatgcgtggcacaaggggctgaagagcctctactactgccgctccaaggcggcgaagagcatgaaggttggtaccgggggcgctgagcctctgaatgccctcccagtgcgatacacaatctccttggacgaggacacttgcctgtcctgccaagggtaaggagcacacatggcgttaaccgtggaaaactgtctggcgttgcagtacaagtacgtcaacttcagttatccgatcacgatgaacgaagacatgatgttcgtggtgccaattccaccatacaacacctacttcctcatcgacgcaatggaccattcctccactcacggaggttcccaactcaagctgctgattgcgggctggttcctgttcccgcctaccgctagctatgagtggaacatcatgggcgttgccgaggctgaaaagaacgagctgttcatccctcacgaggtggaagaggcagacatcatcctcaacccgatgcaacccccgccagaaggccagatgtggccgcatgaaatctggactgggcagtaaaacaaaggggccttcgggccccttctttgaaaggagagattgtgagcgtatttgttgaaagcaccagttaccgtccctttgtttacccttgggcagtcgaggcagctcgggtccatgccatcgatatgcactgggatgttcaccaggcagacctgacagacgacaaacaacagtatttcagtacctctgggctgggcaccaatcaggtcccccacgaaaaccataaatggttgctggataaaactctgtccatgttcaccgagatggaccggacagtcggcgagggctacaccaagctcctcccgtacatcaagaacaatgagattcgaaactggctcattactgccgcctcccgtgaggtggttcaccagcgagcttatgccctggcagccgaggagttcgggttcaccgatggcgattggaaagcttttgcctcctacaaggagatgcgagacaagctggaggtgatgggagagaatcgtatagacgcaagctggtccgagcccctccaggccgcttgcatcctggcccaacttctgaccggcgaaggtgtaggcctgtttggtgcgttcactgtgctgctgaacatgaagcgttgcggcaagctgatcgggttcaacgacatcaaccagtggagcctggcggatgagaccgaccacgtggagaagaatatccgcgtcctgaaagccatgcgtaaggaccttaccccggaagagaatgcgatcttggaccaggaaatccgatacctgatcgaagactaccgggaagccgaggtcaagtatctggtcctggctttcgagaagggccctcagcatgacctgaccttcgagcagactgtcgagtacatcgactacctgtgccgcctgaggctctttgaatgcgagcttctcaaggagcaccaggtgggtgagaacccgttgccctggatggagtggatgatcaacgccgcacgacacgacaacttcttcgagaagaaggtgacggactacagccactccaagctgagcggtgatgtggattactccaagtacaatttcatgttgactagccgagccggttgacctatcatagcccccatgagctgaagagccgtgggggctttttcgtacctggaggattttatggcatctcttttcattcttcggatagaaaccgtgtgtggcaagggtatgtatgccgacgcactgagtagcagggtgcaatccaaggtcctccaggggctaggatacccccgatggcaggctaccggtctctatatcgatctttgcatgtgtttagataaggagaaggagctacatcccgtccccgaggaagacatccccgggtgggaagaccttgccaagaatgaaaaagagatgctcacttactatttcggcttcagttcctgggagcaagcacgagagtgggtaggcttgcgtgctttcaacgagatgggtatgctaggggccaacctttgcatttacgaaatgaaagaggaagatgtcctgctgggagggaaacaggccgccttcaaaatgggcaacgctctccgggtattgaagatgcccattaacaaggacatgcaagatttgatatgggaggagattgaagggtatgacgactaagctgctacgtttccaggcagagagccctaaaggggagaagatcacattttccttgaactggtggacagacgggagtacaatctggtatcgtatccaggcggatcggggagcttcccgggcttacaccgacatcccttgccagcaggaggccatgaaggacctcatggaggctcgggaggtgtggatcagggaagggttcctagacaagttcacctcatttacaacgaaaggaggagttggattccatgagtaaagaaatcgaagcgtttgacgtggcaggccgccgactgcatgtgggcgaccaggtggctatcgccagcaccgcagggaaggctactgagatggtagtcaccactgtggaagctgtccgggcgaagacggtaatcctgaaacatccgactgcctggggtgctcaaacctctcggcgtcactcggctgtgtgcaagattcccgaaatgaatggaaaggaggtgtaaagtgaacaagactattcgagcccagctcaacaaccactacgaccggcaggggctgacgggtaatcatcgccgtctggcgatgaaggctgacctccgcttggtagagaaatacacagaccctgacatggcagcctggttgaagtcttcagaccttgtcggcctgggaagtgccttcgtatgggcgaacactccggagggtcatgacttctggcgggataaagaggttcccaaccgttgacaggatgtacggggccgggtaaactggccctatttcaaccgggaggtaaagatgaacgatcaaaactacgatttccatgcagaggggaaattccccgcccattgcgacgaacgggctgaacgcttcttctccctggttttcgtagggaagagtgtcaagggttcggataagtacggctacacctacagttggaactcccgccacgccgaccttcaacctacttccacccttcaacagcgagggtcccactcctgctccttctgtggtcgtgctgctcttcctatccagaacagcggggatcggtttgccgggtacgactactccgtcgaggggtacacctgcatctgctccggcgccatggacgagcttgactggattgttcaggcccagaggatgaagaaacgtcaccaggaggaagtggaggagatgttgcttcaacgtccggtacctccaaaagatgtccgccaggagctgacaaaaaatcgtctgatgaggttgctttctgacgtggagaatagtaaccttgtctccgcaatgaggctcctggagataacctccaaccgcccctcagtatggaacgaaagctatgaacacttgggcagctaaacgccaggaagagatggtagcctgcgggtactctttcaaaaagcacgaagatgggtattgggagtgccgggacgaagagggcaccctcatcgagactcaccgccaactgggcaaactgatttcactgatggccagctccctgggcatcgattaggaggattccatgcaagacctgtatagccaacaccgcgccgccgtcaagaaactcctccaagaggggcgtaagctcaaggcgacctacgtcatgaccctctacatggagggttccagcccgaaggatgaagaccctatggtagcccacctcacgttgggtaaaacctatgatgttatcgcagacggtctgtacaaggatggttccttctacgtggtggacgatgagggctgggatcacctgtttaccctggatatcctgcccgaagaagacagatatccacggttcgatgtgttcgatcacttcgtgttcgacgtggagggtcccctctgatgtacgagattcagttgatcaacgactgcaacggttgcactgctactctacaggtcgccgatgaagaggccgctctggatttaatggaggagatggagtatgcctggagccggtatggtagtgattggatgccctcgtggttagggttcaatccgaaactgtcttgacaacctaggagggctcccctaaactgagccctcaaccacctttggaggatttatgaacactgctcaaaccatcgcagacatcttgattcacctcgctgaccgtctgtacactcagaagggtcgatgcctcattggcgggcgctgcaactatgcagatggccagggaaaccactgtgctgttgggcatcttctcagccaacagtcgtgggagttcgcttccaagtgccacggcggcgtgccatccctggagaacgactgggcgcggcgtaaagatggaagtgtggagactctctatgacgagaagttcttcatcgcagacatcgatgttcgccgccgtctgttggactctttgcagttctaccatgatgagccgtctatgtactggacagtggctaaaagcccgtcattctcaaaggtaagcctcctgttgtctatggtggatttcctgaacactcaaggcctggactttgttgagcgcccccaatctagtgttaagggcttctggtcggaagctaaaggaattcttcgcaataaggggtaccacgtatgaacaaggctctccttctgaaagatcagttgacagcagccctacgatgtgaagaccataccctgcaaggtgttgttagttctatcgtgttcggccctacccaggggcttgatcataacggtgttgcgatccgtgggccgggacttctaagtgatcaccgggaactggtacagcgagccgacagggtgtggatgaacatcgcctaccgtcgagaaggtttgctagtcaacatgaatggctttacccggtctgtggtagatgtgtttattctcaaagacaggtatcacgggctgacagggttgaggtccgtgggtgtgggtgagggatgggcaaatgccctggccatcgactgtgccctgctgaagaagcagttcgaagttattgtcgaaatcccttaccagtatgaggggtgggcaaccgacctggtacgggcaggtgagattcctgaaggtgtgaccatcatgtcctccggggtgtagatatttgaggggctggggatatttgctctagatatttgggtggccccctatttcgagctagatatttgaaggggcctcccagcctcgctatcacattttaagccggcccctgactcacggcctaggttaggggagaaatcgtctcctaggcccatcagaggagcttacaagtgcatatcaacatcacgcttacagtcggtcctgagattcgttgtaagaagtgcgactcccccacccctgcccgggatatcgtagaaggcctctgcccttcctgccggacactcaaggcctgggaggcgctcgggcaggctgctcaagagctgtgggcttccactttcaagagcgtcaagatcgattccgttcggcttgagcaaggtacctgacagattttcacagccgggcgtaaggtactcgacagattttcaccgagcgcccaaggtactcgacagatttttacagagacaggtatcaaaagaactgtcaagtttccctccccaggcggcccgacccctcggcctcttgtagcacgtcaactccccgctgtagcacgtcactcccccggtaagtagctccctatctatccctccctcaccgaaactacctttcacatgcaatcgccatgccaaccttgaaaagcgcgcaggggcggtgtttgtctccggcgcccggcccctccggcctgctttcccgcatgcctccagaatgccaggatgagcctggagtgtcaagccttgtgccaggatttttcatcgccgacctggcatgttccttgctacgcttgcgcgttcctctacctggcgttgccagagcaatttcttaaaaagggggggttgacttctaaccgtgccaccgtagaatgaccctcaagcaaggcaaacaacctgtaggaaggtaaccatgcaaaaagctctctgcaatcaacgtgacctgtacgctgcctataaccgtggtgagtatgaccgcgtggccgtagacctgaatcggtacttccccattgagcgggataatcagtgggaagatggagatgcgaacctgcgtcgtcgcacctatctggtgaagcactcgaagggcgtggccaggtggcacactctctatcgtaatggtcaggttcacggcgtcggcgttatcttcgacgtaaagccggacgaacccttccgaactgcctgaggagagacaagatgcctgtcaaaataggggatatagtagccatccggggcgaccttcggaaaaagctcgacggaacgtgccaatacacgcccgaacagttggtaggtggtaagttcctcaagcataccggcacgggagaaatatggactggccgagtgagtaagatacaaggtgatatggccaaggtgggaggggtctggcgcgggatcgaattctatgtgccggttgacgaaataaacgcttgacaacctgattcactggcagcacaatagcacccccaaaccccgacagaggtaacacacgatgcaaattcatttctcctcccgtaccgcagcccgtgctttcgtgaagggctcttccttgcctcgccaggtaaccgataacggcgcggaagcttcccgccgctggggagtcaagctgaatatctcccccagcgtccgagtgctgggctgcgaatacctcgcctttggcaaggctggcaatacggtgcctgtctacgtcaagtaacagcagagtgcttttagggttgcccctggacgccgggggcagcttgcctaaatccactccgtaggagataacacgatgaacactgttcaaaaaaccgtcctggcttttgttctgaccactcccctgtccctggctgctggcgccatgatcggcaaggccgttgccctccctcccgcactgaaagctcaggcggttagcctggagatggcgcatgccaaggacctggcagacaactacgttcccaaaatgaacatcatccataccgctacaggtgctatcgagctgggccaggtgtacggggaccgcttggcgggcgaagtcaaaatggtcgttaagggcaaagtgatggccagtacgcacattaacggtcgcagtgttcagcaagccctggaggaggcagcaggtggcactatcgaagatcgcgtgctgaataaggatgtcactttccgaatcaccatggatcgcctgtaccagtccgaaaacttcccgcagttcacagtagtgatgctgaactcctctgtctatggcaaagacggtgacagcctaaccgcactggctgcccgcctggaaaaacagcgcctggccacggtgaagttgttcgaagaaacccgaatcctgaaataaagtgttgacacggcatctcgtgtctgtagaataggcatcacagagggggacggtccccctcctcctaaaaggatatcagcatgaccactctcgaccctaaagaactggcacgtcaaggcatgatcaaggaagctgttcaagctttcaaagatatgggcgtagattctccctggaatgccgagaatgtggcaacattccgaaactacgatgtcaccctgggcgaggtggacttgtccgaagaggagttcgtggaagagttggattccatccacgaaggggttaagatagccaacatctctttctctgccggccaagtgctgctaaaaatggaccccatagctttccgttgcgcatgcggggagtatgagtctcaattgaccgaggagttggaggaggcgctgcgagacgaagacgacgattgtatcgaattcttcatcgaccccaccgattgggaagcggttgaagaagaggaagaataagggttgacaaggggccaggaaactcctaaactggccccaacaccaacgcactgagggtaacacaacatggtcaagttcgaagagattgcacaacgtttcaagaattcccaacgccgctgggacaagccaggcgtcatggctgccatgcaagaggctgtcaataacgctcccgtcaaggtagtggtagagtccaccagcaaggcgctcaagcccgacacccctaccgttcggatcatcgtccgggagtggatcaaagctcggctcggcgaggagttcacggtgtacgatatcatcccctacgtccaccacctggccacccccagcgatgtgaacaacgccctcaagcactggaaactgcaaggcgtgcaaatcccgaccattcgccagcagcagagggaagcggggaaagctggccgcccgatcaatgtgtatcgttgcgatgagttcgcagcctaacctttcactctgaggagatatatcatgcgtactgacaaatccggcgcccgttccgaacgtaaagaagccatcaaggcgagccgtgagcttcgcaacctgcgaaagaacaagcgtaaccagtgggtcagcaaggactaacctggcgcctggggcgccttccctaaaccctggagaatgtccagggtttacgaaagatgctctagatgttaccctgcaaccccacatttgaggtttaatcatggtcattgaatgtcatcctggacccgtagagtattgcttttccctggcgctgtgcctggctaaggcgggggttaaagtgaaactgttccgaaccggtaaagagtggggagtgattccgtgccgaggcgtttaagagccattccgacctgggtatctgggggagatgaagaagacaccccgcgcaagcctgtcctttcggtgatagaccgggcttgccctatccagcggaagttaaatgccctggaccgagattgcgaggagttacggcgcaagcaagacaccctagagcctgccacttttgaccaactggccaatagcctggaagagcgccggcaagccttgtggaaggccttcgaatccaagtatggcgcagagcctgaggaggacagccacgacactatcaaggctttggccgatgccagtatccagcctgcgcaacatgtggacatcggggcactgctgttgctaggactggtggcgttactcttcgccgcgtggctgttcaaataaaagatcaaaaagggcttgacgtgcgcaacggatggcctagtatctctctctcagaaacacaaccccttacttacaaggtagatcgaaacatgaacaccaatgcaaaccccgcgcaaacccttactcccgccgacgctttggaagcggtagaacttctgatgatcctgggaatcgaggcgtaccagtccggtgcatggttgaatgaaagtgattcaactgttcaggttactgacagcgctattgcgttgtggaacgacacgattaaccgctacaagctgctggacctggcacggacgtttgctgaagaagccagcttgttagaacttcaaatcaaagcccgggaggtttgctaatgatcagtctcgttctcactctctgcactgccctggcatgtgatgattatgtgatcgcgcaagacagcgatgctgacatcatcaatcacaccctgtacgttgaatctgaagagttaggcgatgcctgggtggcccctaacgccaacgaccgcattggccgctacctggcacggttcaacatctccactcccccggctatggtagtggactacgactacactgtggagggtaactgaaatgcattggaacattctcgacgatgtacgcgccagcctggcaatggttttcctgttcgaagcggtccatgatgtggctgcctggaccctgctaggtcataagcatggctttgccattgaagacgtggctgccctgtccgccgagttctacctacctctgacggaagtgttccaagccctggaggaagcatctggcgatgtggaagaggtaagggaaaccctgcaacaggccgccgcaagtcgattagtcgatgactccctggactactacagtcgataacccaagccccgctcatgcggggcttttgtttgcctgaaataaagtgttgacactataggcccttcctgtagaatggccgccatacacaaggaaaatgttccacaacatcatctggagataatcatgcgttcgatcaaatccctcgcacgagaagcctacaaaaaccgctatgcgtttgcacgtgtaaccgttgcccgtgatggaaatatgctcgggcattgggctgaggagggttttgacccggtgaagctggggaacatccacgattgttccaccacggtgaatccgagaaagactggcgtttgcttccgaaaccgtgactttctggtattcactttcgggatggaggtccttaaataaccgctcgcaaatctcctttaccagcccggctgtgccgggcttcacagtaaaaacacaggcagagccgaatccccggggcttgacaccagcgatagccccgatagaatagccatcaagcaagacaaaacctgacccggagaaagcaaaatgactggtagcaaccctaacatcgacccgaacactgtggccctgttcactgagatacgtttctacatggcgcgcgccttctttgcccatgcattcgcagatcaagctgaagacgccggacagcccttgcaaggtgagattctcgaccaattgccgcagggttggagcgcggattgggcacccttccatgcggcggacactcttattgcacaactggtcacaggcgtgaaggctgggtaccgttctgaaaaagttcagaaagccacccctgtagagatcatcggtgccctgttcaaggcttgcaagagccgtcatggtgggcgcgcctatgaccgtgaagcgaccgccgagaacttcgggcattacctggcaatgggcgccatgggaacgggggtaggtatggagtgcttcggcccggacgtggcaaagtatttcgaagggctgccctatgtagagttcggctcgcacagcctgagcaaagattatttctgaggagaacactgtggcaactcacaaggcaattcgtgacaccctgtctgctgtaacctccctggcatttgccgaggttgaacgcctggcgcgggaagtgttccgggaagaccccaactgtgtgaatttctgcatggctatgggtagtgcatccttctaccgggagtggatagattgtaacgatccggacggggattggcccatgaacgagtacctgagcgccgaggaagtttatgaaatgtcaggcagccaggccgccaaacacctcgacagccttctgacagagttcggggaggcgcttcgtctaactggccaccctctgaagttgacccggatgactgaagacagtatccttcgacaaacggactggtaaccacctacatcgggagtctccctcaatgaagcaagtgtccccaaaattcatcattcacgattcgcacctctaccgtgctgccatcctgcccaaggtggaaaaggactctttgggcaactggtacactgcccgatatgtctggactaaggcagggattcctcttgccaggttgatcgcgggagaagatcaaaaccccctggaaagcttcctgctggcagagggcgctgttatggaccttggccaggccgtggggacgactgtggagcctgctactccctggattgtctttgtaggtgatgatccggtagcagcctgcactaccaacgccagggcgcatctccacatcgcggagcaatggctaaacggaaactctaccgccaaggtgatgcattgggatgaagtcaatccggatgtgctggcgcctatcctgcgtaaactggttgagcacggcatctacctggcgacggacggtcagaacatcgtgaccgtataaagttgacaagacccttttgggtttgtaagatgcgtgtcaaagggaaggcataaagccttcccgcttcaggaaggtgaacaggaatgaacatcattgaccggacccaaggccacgagagtcccaatcactgctatatcgtcactggcagcattgggccagagttcgaaccccttcttttcacgtctaagagtcttgctgttcaatacgccaagcaaatcatcaagcacggaaaagcgcacgacgttttcccaccctttacgcctgttatcgagacccgccacaaggctgatatgcaccggttcaccgtccacgacaaaatccctgaataaaagcttgacttccctcccgcttcccgtagactaggcttcaaagggcaaggggccctctttcataaaggtgacacaaatgaaaaatatcgaactgaacatcggtggcaaagacttcactttcaaggtggaggtggtgagagatgatgtgcatggggccccttgggaagagcaagatgggcatggccctgtgagcgattggacctgtcgagataagcgcccgggcgagttagtcttgaacagtaacggaaccaggaagcgtttctatgacttctccgaggcctgccggattgcccttcgtgagggttgggattcttatcctcacaaccttgttggcgagcaatccaaacgccagcaagctgcaaaggccgcccgtgccgatttcgaaaatcttcgtgcatggtgccaggatgaatggtattgggtcggggttattgtcaccctgctggacgaggaggggaataaaacggacatcagcgactctttgtggggaatagccagtaacgacgaagactgcatagcctacaaggctggaatcatcgccgatgacctggcaagcggttatggcgtccgctgggacgagacagcaaaaactaagtacgaattcttctaaaatcgcttgacagcttaggccattcgcgtagaatggccctcaagcaagacaaaccaccaacaggcaaaacccaaggaactaaatcatgactactgaaaaccttacctctcaagagatcgaaacttctgttgacgaattcctgaagtcaatcgacgttaccctggccaccgtgcctctcggcgagcgcaaggttgaagactgggtgcatgacctgtggagtgtaaacttcatccgtggcgatggccgccgtggcgttctcgacactgaattccgtactggcatcgggcaccgcaaatccgaatggccgatgccgctggacatcgcccgactggcgccccacattctcgcccgcgtggaatgggaaaaacgccacctaaagcctgtagctcccaaggccgcctgtatcctgtccagcctcatccttgactgcgatgtcggtagttccaccttcgaagaattctgcggcgacttcggttatgacacagatagccggaaggccttggacacttacatggcgtgtcaagagactacatccaagcttcgccggctcttctctcaggaagaggtcgaaactctccgtagtctggtagagcattactgatgcttcgcgtgtgctacaagtgtctacatattgggtatcctgttagaaccctaagccggaaaaccaaggtctggtacctaggctgccccctctgccgttctggagtcttcttttcctgaacccaagcccccaatccgggggctttcttttttcctaaagggcttgacctggccccctcttcctgtagaatgcgcatcaaagggaagcacaacgctccccagacaggagaccatacccatgagccaggtcaagattcaagagtacatcgtagccgagatcaaggttaaccattgtgctcatctgcgaaagggccaaaccatccaagcccgcgatgatcgtagcagtgaaaagtggattgcattcatggtggaacgtgggtatagtgcctctgaagccgctatcctgttcaaagatgcacatgatgtggcaatgctcgaactggcagcataactctcgaagtcaagcaaacaaaccccggagattcccatgaacaccttcgcatacgcccactacgtcgcccgcatggacaaggcctcgggttcgagccttccctactccaccttgttccgcattgcccttcgtaacgcctaccgcaagcctggcgtccgccaatatgattacactgccctcgccgaggatgtcaaaggccgcgaactggcccaaaagcgcacccgtgctgaaaaggctgtcgtgatggctgcggtaatgcgagggattcgcatgggcttcaccgtgagcgtgaaagacggcagcgatggcgaatgggtggttcgtcagtctaccgatgtcaaggaaatttccgacagcctgcaatccacctgtgacgatgttatccgattccgcaaagggtctggccctgagaacgttgtcggctccctgtgggcaatctacggcaacagcgctggcgaagtgatcgcggattggtcggacaatgacaccatggctatggtgatggctcccgcagagcgcaagatggaaaaatacgctgagatggggatttaatgctttacggggcccggcaagggccccataatgtacccatgccaaacaacagccctggagggcaagacgatggacatcaaagcgcgcaaagcaaaggccgcacagatgatcagtgctgctggatggtctgttgaacgcatcgacttccgccgcaacgtcatccgcatcggcaacgccggtaaaacctccttcgtaacactgtggcgcggcatgactgacgaaatgctggcatcacaaatcgacttgaccattcgcacctcctaacccccgtcccggttcgccgggacatcgctttgaaggataaaacaatgtctgagcaagagaaagatgaactggccatggtagtccatcagcgggatatgctctttgcggcattagattccctgatgcgcgatacagggcttgtaaccctcatgcgccctgatcaggttgtaaggaacctctgcgcccttgcagaatacaagtgtccatcccagggacgccagataggaggcgaaaaatgaagagcaagtatggaaaaaacatcgctgcggaatataacctttcctgccgagttcgccggattacttttgaaagcgcccggcgccaccctgacagtcgcattgtgaagctcgcagcatcctacgcctgtgctgcctatggccgtccttacaaggactgtatcggtgcctacaaggccgccaagcggcgagagaaggcaatgcgaaaccccgccacatggaagatcaaccgggaagctaagcgggccgtgcagtggctacaagctgccatgaacaaacgcaaataaggctgttgacagcctaggccattcctgtagaatggccatcaagcaaggggataagccccaagcactaggaaggaagacgacaatggtcactatcgctctgaatcacaaaaacatcctcgacaatgcttgggcattctatgcagccgacgttatggtccgtatcgaagctatgcaggccgaggaagagcgccagatgcgtgagtgcatgggtaaccgcgacaactatgacatagcggaaattcagaaggttgtggcctacaacgaaagccagggttggacccgtcgtgccaaaatcgcccgcgcaatcctggccgagcgcctggcagaacccctgattcactcggtagacatcgcctttgcagtggaggccgatatggaagagattcgccgagtagaggtccacaattccaaggctccgaccatgcggcagttgatcgaactgcgtgacaagtggatagccgaaggccgagtcgatttgcatgcgcagactgtggagcttatcgatgggtgggctgatgcgatgttgacagaaaaagcttgactcctcttctccctgggggcattatgtctccaacgaaacggaacagcccccaagggagaaaaccgatgaacctgcaagccattgtcaacgccctgttcgaagctggcgaagagttcaaagcctgcaagcgtaatgccagcggctcgatcaacgggaacagcaagcaagctgtgaaaaagcgccttgtggccaaactgatggaagctggcgagaatcgtagcgacgcttgggccatggctcacgatctgggacgtaactataactaatcaatcgagccctgggagaccggggcttcactgagggtaagacgatggcaaagcttacagcggttcgcgagttcaacgaacacggctacaactggtatccgcaagtttgggtcgaggctcttcagctctggtgcgctgtcagatgggtccgctaccagcgccctgaaggcttcgtaaccgccgccgacgccattcactttgccgaagccggcatgtaaccatcccgcccggctcgccgggcgtaaccccaagacccggaggcaacatgaacgccaccctggcacgtcttcagaacgaacgctgtgcaactcttcgattgatgctgctcccggagcatcgtgggtacaagttcactggccacccctgggccgagcgaattcgcaatctccacgatgaagcccggtgcatccgcagccatcacaactaacccccttcccagcccggcacagccgggctttctctcataggaggaaccatgaaagttcagattggccagcataccctggaagtcgtagctcccgcccataatgtccccaagagcgacgggtgttgcagtgtgcttttgaacgggacactcctctacgttggtttcaaccctcgtgacgcttgggggctgttcgaagacctggagaaagccctactcagcgtcgaagctcagtcggtagagtctgaggaggccttgcatgactggtaacgtcctggggcagtccccattcaccccctatgcctcagtgccaggacctatgtttgaattcgagtggttcgacgtagggaatgccgtcatagagctagagccaggatggttagtaggggtagggtttggagtggacagcttgtttgttcttacctacgttgaaagggaaccattcgccgagtggctgccctggacccctaacctcaggtcctagattctctattcggtcgccataataatgaccctggggagggtcctacggaccgtcacgataacagggaattatggccatgttaacagggcctataggcttcgtagaagccagtttagcttaggcagtaccctagtatggaaaaggccttgaaaaggccgtatgcgcgcccccagggggcctatcggggagggagtgggcaagtgccccctccccgtgtctaagccttatcaactggactcttcgagtccattccaacaggcttctacgaagccatataatcaccagtcatatcaccaatcatgcgcagagcatccgggtaggatggtcaagccattggtctctcctctctgtcaagaattctgtaacaatcactaggtcacgacgtgacccattgtgtaacagtcggcagactgtcattcgggcaggggcatttgcccccttcctgccctcctaaactagctggcttcgtcgaagccttcccatgccaccagcccattatgtaacagcctggccatggtcatggcccattgtgtaacggcattgcatgccaggatcaccaggcagcctcagctaggccaattgtgtaaccattcctcatcccagcagcagaatatccccagccaggaagcccatgcccctccccattgcatcctaggtgcccagccccaggaatacgtcgattgtgtaaccaatgaccacccatgccctagtaggcctcttcgaggcgagctaatgccggcgtctctctaccctcacgggaagagttccccctttattatggcgaccgaatagagaatgcccgattcgtgcggcctgtaggccattacaatggtcagcccggggaaggattgcattacacaataggcttaccctcacccctggattgacaggcctcttcgaggctagccaggctcagacaggcagcttgagttacacaattcaccctcacatattgccccactccccatgc

SEQ ID NO: 16 - DNA, 42018 bp, Podoviridae Phikmvvirus
  misc_feature (1)..(42018)
tcccgactctgatcagcccacccttcccccgtaggccctccgcctggtgggccactgcctcgcattgcctgggtgttgcctgggtcatccctgggagcttccagctacgctgggtggtggtgggcttccctgccctgtcgctgtcctgtcgccgcccattctacgcatcctggcgggagtgtcaacccctgggtggtcggtgccttgctcggctacgctccagcgcttccgcgtggtcggctaggcggttggctcgccagcgcttcgcccactctacacctcgctccacctcggaccacttgtccgccagcatcatgcgctgccatgccgcgtcctgctgtagccatgccctgctggctctgtcctgtctgctcagcatcctctgtctcctctgtctggctccctggggcttccctggggcgctgctgtggtcctgtcgggtgatggtgcgggagtggctggccttgcctcttgtgcctctgtacctgtggcattgccctggctctacctggctgctccctgggtattccctggggctgcctgggtggccctggccactccctctaggccacgtactctactcgcctccacctgtcctgtctagtcctgctctgctccctggagcttccctggatgctacctgggtgctggtctatctccctggctctgcctggcgctgtgctgtgctaccgctggtcctgctgtcttgcctcgccgctccctcgcctgctcggtcgcacctgcggcgctgatggactcctgtttgtccattgtgtgtgacataaccgcagccttagtgccatgcgggttccagggcgatgggtctggctggttggctgctccctgggtgggggctgtcgctccctggtaacgcaaatcctggctagctagactaagcctcgcgcatggggtctctatacgcgtgggaaggctccagggagcgcctggggaggggttgacacgttggcggtaggtctgtagagttcgccctgtcttcacgcaataccgccttcacaggcagcctggagacagggttgacacactacccgggcatcggtagagtacgcagccagaacgacgggagattgcaaccttccaagcgcggcacaagccataggcgcaagggacacggcaagctcttagggcaggaaccgcagtgtgtaaggccggcaggcatcactggggggattgacaaggtaatagatgcggtaagatgtgcggcgtcaagtggtcccgatgtacacactgtgaagggattacggcgcggtcagacagatgaccggcaccgcttgacactgtaaagctcagtcggtacgatgggcacccatagcggacgtgatggtccggggcgatgcggataggacgccttgtttataacctgaccgcaaagctgtgactccagccgataggactgacccaccacgtaaatacagacgggttgacacgacaaggccaagtcgataacatggccgccacaaagggaagcgatagcttcctggcggtagaggttcgaagcttcaccagcggtacatggactggtgcggtaggttgaccgaagctgcaactggttaggcagggtcccagggaatacctgtcgggtgctgaagactcacccaaaagagtctgagcgggaagcctccccgtccacggttaagcaaaggcacgttagtgccggtgggaacgaatagagtgtcagtgggatcgagaactagaaacctcggttaatcgcgactgacagtatgctgggtagtatcggtgggccgattgaacaaggccaggcagatagcgcaaagggtacgggggatgagtgaagacgatcccgaagagtatgcgcaggacaagccagaaccgctgatactacagggactatgccaatgccaaggtttgtcccttgaggcccttccaccgaggggattcaagagacagacctagttgaggaatgccgatggcacacttcaaggctaaggctcccaagtcgcccttcgctacccaggtagcgtactggcgggattgggaagccaaacgtactaagctcatcgcacaggataacgtcgaggggcgcaaagagcttcgcaagatgcgtgacgtgcgctacgctaccgacccggagccagcgccaggacgctaccataaccctgaacagaaagcgttcgtgaagggtagcgaaggcaaggcgcggaacatcctgaagggatggaacgctaagaagtcgcaagggaagggtttgtaatgccacgtgtgaatgaactgacgccgcgtcaacgcaaggccgccaaggctcgccgcgacaaggcacgccggattgatctagcgcacaagatgccgaaaggcgccgactgcccgatcttccgcaaggctgaacaggcgcaagctaagcagccccgcgtcgataccctgaccactccccgcagtgccggctacctggccgccgctgcttacctgaacaaatccatctgaggtacataccatgaccaacgcaatctccaaaaccgtaatcgcattccgtggcaccgaagagatcaatcgcgctatcgacgccatccgtgtccgtggcaaggaactcgacgaagccatccaactgaccggcctgtcgatcatccatcacatcgaccagtgtggtgacgtgaccgtggtcaaggcgctgtatgaagccatgccgaagggcagccgccgcaatgcgctggtcgagtggctggtgctgcacggcaaggtacaggtgaataccgacaagaagtcgaacaaggacctgcccttcctgtacaacaagttcggcaagaccgatctcgtaggcgccaccgacaacccgtggtacagcttcaagcctgagaaagcgctggaccaggagtttaacctggccgctgccctggccacgatcaaaaagcaggtgctccaggctcagaccaagggcaaggtgatcgtcggcatggaactgctgggtgatctggaagcgctggccgccaaggctgcacccatcgccgagcagagcaagcgcgctgccgcccattgactcaagtcgaacgcctgctaagcgggcgttccgctggaatcaatgacaactggagaaacacgatgagctttaagcaacgtctgcaacgtcaaatcgccctggcccaatacagccgcccggctcagttcccgtacggcgagcaggccgtccaggcgaagggagagtgaccatggacttctggattgccctccccttcctcgaactcggcctcaacctcggcgaggatgaactgcgcatgttgtggttcagcggcctgacggtattcttcatccacctcctgaagcggtgactcaagtcatggccctggcgggcgaccctcgcctactccggggccatcgctggactcatcacaagcgagaactaaaccatgcaagctttgaatactctgttgatcgcaatccccaaggacccgtcgaacgcattcaatgcagccgacaaggtgctgtgcgcccatggcttccgtatgggtgacctgaataccgcgcacgtgctgacccctggcgggttcgtagtagtgggcgccgagtgaccaaggcgaaggctggtgcgccagccttccaccgtggccattccttgccgcgaaccaactcaaccgaggagctacaacatgaccaacgtcaacaccgccaccaccgagaccaccaccgctgctgccctgggcgccaagctcatcaagaagccggctaccgtggaagacttccgcaacaacgtggtcttccatcacaccgccctggccaagctgaccgaagtctacaacgaggcggtcgttgccctgcaaaccgccgagcgcctgtccagcctcgtcgccggtgacgtgatcaccttcgaccacggcaagggcgagaaagccgaagtgctgagcggcgaagtcatcagcgtggttgccggcgtttaccaggtgctggtccgcttcagcgacagcgcacctgccaagctgctggacgtgaaggccagcgccatccgcgccgtccagtcgtcggcagcccaggctgctaccctcgacgaagccatcgcccagggcgagtaaggcccgcacgtaataggcccggccctccgggcctattgcgagctagccataccataggaggagtcaccatgagcaagcgtaaccccgagcacatcagcggcgccgtgcgtagcgtcagcgtccagaagtcggcagccgtccaggaactggaggatcgtctggagtctgccctggccgtgtgccagcagcgggcggaagacatcgatctgctgagccgccgtctccaggccgccgagcgcgcccgccgctgggagatcgacgagattcgcaaccaccaggcgaccatccgcctgttgcagaacgacctgaacgctgcgcatgatgcccacgaggcacaagagcgccgcgctcgcaaggcaaccatcatggcctgggtatgcctgctgaccgcaggtttggccgtcaccctgaaactggcaggagtctgaccatgcagtgcaacgacctttacactaagctcgcagcgagcatgttcaacgtgccgtgctcccaggtgaccgccgagatgcgccgcgtagccaagagccgggcattcgcgtatgcttacactcccaagcgacaggcgtcgggtgggacgtacaccgcccgcgtgagcggcgtcacctgtgacggtggcaaggtggaggtacgtctggacaacgtggagcgcgccgacacctgtggctatgccaagctggaggcgctggaagcggtcagcctgtaccagggtgccgcgaagcgcgccgatgagtatgaaaagctactgctccaggcattcccggtggtggctaagcgtcgtgagcgcttgcgtatctccgggccgctgtcggcggaagacttccgggcaaacctgctcgggacgtgttccgcatatcggaatgccctcgacgccatacggggcgagattacctcgaccggcccgttgcggaaccgcatatgggcgctggtcgaacgtatgcaccgggccgagacgaagctcaggaatgctcagtcggagatcaaccgcctgcgggagcaggaactggaccgcctccgcaaggacatgtccagctactgcgccaacgacgttacctctacggtgagtgcagcatccgcgaaggataccctacgggtggcaaccttcgccgccgccctcgccggtggcgtcgtaggtagcgccctgatgttcctgctcagctagggcgaccagggcctactccggggtcaaatctgagggcgttcctagagcgccctctcgtgtgagtctggaggatcacgaacatgcaataccatttcacgcattacaacggataccgcttcggcgtcgagctggaagacgaggctgtcttcccgtgcatcgacggtaagcgggcgacctgggacaaggtggcggcgtgtgccggtagccttgtgcattacatggcgcaggacctgattgacttcggccagcgcaagttaagggagatcgaagatgagcaagacgagcctgtacccgctgagcctgcatcccggcctgattcaaatcaggacgattcacgtattcagcattcaagctccgagcaacgccgagaactggtggcaatggttcctctggcagcggaagtaccacccgctccgggagagcctgagtccagccggggaactgagtgcgagtatcgccgagtgtgtccaccgcctccgccagagtggctggcaagatagcgacatctggcgcaagaagggaggcgtgctggccctcggtgccttcgacctgtccggcctgatggtgggttcctgcctcgtagtaggcggtgagctgaaggccctgtgcgttgatgaccggcacagcaggcagggtatcggcgctgagctggtacgagctgccgagctggccggtgctgagcacctgacctgcttcgagttcctggagccgttctacgccggcttgggctggcgcaccgagcgccgtgaggcaaactggactgaaggcgagccggatgtgctgtacatgagggcacctggccatgacgcatgaggtgatggtatggcttatcgcgaacaaaccgctggtcatcggagtcgccttcagcctggtggccctgggcgtgctgctcacacagaacaacggcggcccgcctatggcgcccgcatgacctggcacctccaggacatgttcgaggcccgaggtgggctgaggcccttgtgggaggagtggtatcaatggcactgcgccgcgactcctggctaaagcaagcgcaatccctggcagtcggccaggcgggtcgattccgccacgtcctgggatgccagagcatgagccggggcgggaccaacatgacctgcaagaacctgcctgaccgctgggtggcatactgctactcctgtcaggaaggtggcgtggtcgagaaaacgcacgtgcggagggtgcaatgcgcggatcaagaacgcttcatgccctggcccgaggatgcctcggactggacgcaagccgactgctatcaatcgctatatggtttgctgctgtccaagggcatcgactacaacgtgatgacgccggggctgccgctgctctacagcgaaaggcagcatcggcttatcttccctaccgacgcgggctggattgggcgcgctactgccgaccaaaatcccaagtgggtgggctacgggtatcctgccccggactaccatggatggccccaggaatcatcaatgggcaggccatgggtgctgacggaagactacttgtcggcgctgaaggtgcggtgggcatgtcccgaagtcttcgctgtcggtctgaacggtacaaggctgcgcgacaggctggcggcgatcatgttgcagcagacctgcaagcgcgccttcatcttcttggatggcgaccgggcaggtgtccgtggtagtgcaggcgtgatgcgccggctccggtccctgcttatcgaaggccaagtcataccaacgccggacgggttcgaccccaaggacctgacccgcgagcagataaggagcctagtaattggacgtattgacgcttcacgcactgagtgaccgggaccgcttccgcacgttgcggagtgtggtgcccgaaggaatgatggggccggagacgtgcttcgtcatcgactggatcgagcagtattggaaggtctacccggtgcatcagaaggtagacccgcaggcactgcgcgaactgatcaagctgcgaggtggctaccagccagagcaactagcggtggtcctgaacctcgtcaaccaactggacaagccggtggacccggactcgctacagggcgttgtgtcccagctcaacgaactggatttctcagggcgggtggatgccctcctggcgcagtacaaccagggcgaggacatcgacctggcgtatgagctgcgccggctgagcgacgaggccctgcgccgcgagggggtcagcacgccgaccgactacgtgacggacgacgtgtttgatatcctcgcggaggagcagggtgaccacggcatcaagctgccggggctggtgctgccggcgtacatgaagggcctccacgccggggcctcggtgctggtggcggcgccgcctgatgcgggcaagacctcgttcatggcctggatcgctgtccatatcgcgccgcagctcaagcggtacttcgacccggggcggcccatcctgtggctgaacaacgagggcaagggtcggcggatcaagccgcgcctgtactcggcagccttgggcatgaccgtgggcgagattcttgccctggacccggaggaagttcgcaggatgtacgccgagaaaatcggcggcgactctgagctgatccgcatcaaggacttccacggtgggtcgctggctcaggctgaacaggtcatcgacgcgatgaagccagcggtggtgttttgggacatgatggcccacgtcaagggcggccagcgcaaggaccagaaccgtaccgacgagatggagtacaaggtggctgaggtccgcgagatggcggtacggcacgacttcatcagcttcatgacgtggcagattagcaacgacggccacgaccagttgttcccgccgcagtcctgcctcaaggattcgaagacagcggtacagggtgctgtggacgtgcaaatccacctgggccgtctcaacggcgcggatcaacaggtcatgcgtggcctgtccctgccgaagaacaagttccagatggacgggaagccttcgaacgtggaggcaatgattaacttcgacgccgcacggtgtcgtttctttgagagtgtggatcatgcaagctaagcatagccgggtgctcgaaggcaccaaagaaattccgctgggtagcatcgcactgttaccgggcaccgtcgcgggcctgctgctgtgcctgtactccgacgcaactcacgaggagggcgtcgccttggccggtgggttccctcgcgacttgctgcacggcgccactcccaaggacgtggatgttgccctgtacagcatgacctgggggcgggcagagcacctgatccagaaggcactcccggtcctgaaccccatcttcgtccgggatggtgggtggcgctcggactacgccgatggcggcgacggtggtatcttcaagggcgtgatgtccctcgtgggctgccgtgggttgaatggcatggacttggactttaactactacgacgccgacagcctcggtcgagtgatggagtcgttcgacttcaccatcaaccaggtaggcatcgcgtacaactggcccgaccccgaaggcggtccgcgcctgggtgcgtacctgcacaaggacgttacctggggcgtgaacagggaagtcggtaacggctcgcgactgccggagcgatgcgagaagatgcgggccaaggccgcgtattacggatgggagaacgtgtgatgagcaagcgcgacgtggtactggatatcgagaaaggcatctggcgcggcgtagaccagaacgacaaggccgtcgaggccatcatcaagaagcacgggtacgtgatcgtcgagcctaagatcgacgggtgccgtgccatcgtcggtgcgcatggcgtggtgtcccgaagcgggcgccgcttcccggccctggatagcttggaagaccgcatcatcgatcgactggcccgccccgggctggactccggcctggtgctggactgcgagatgtacctggccggcatgcccttcagcgaggcgactggccgcatgtcgcgcaagaccccactgaccgaggaagagctggggtgcctgcacttcgcggtgttcgacgccacccatatagacgtgctccgcaaggcgcgcacctcccacctggtatacgaagagcgccgcgccatggccagcagcctcctggcagcttgccgcctcagcgacactccgacgttcttccaggtaggctcgcaggtgtgtcggtcgatggaggaagtcttaggccggtactccctccaccgcgccatgggcttcgaagggtcgatggagaaagacccgagcatggtctaccgcaacggcaaggtcgccggctgctacaagcgcaagccggagatcaccgtagacgggcgcatcgtaggctacgtgccgggcaggaccggcaagaacgctggccgcatcgtgggctactatgtcgagttggaagacggctcgggcaccgtggccgccaccggtctgaccgaggagcacatcgagttcctgacccgtagccaatactactcgaccgtcaacgacacgatgccaaacttcggtcgcatcgtcgaggtctctgcgatggaacgctcggccaacaccctgcgccatcccagcttcagtcgcttccgcgaccttcccagcaatccaggagtcaaggtatgaagattcgaaagtcccgtaaccgcaactacccggaagatatggtgtaccacgccaccaaccgggattcactgctgtatccgaagtacgtcatgggttccgtgttcatcagccaggacggaacattccgcatctgcgtcatggcagggacctgggaccacgttgggtccgaagttctgcatcatgcacgggacatccaatcccttggcgccggtcgccgtaagttgcaccgggtcatgcgacggctgcgccgcaatctgcaacaggtaggagtcaaggtatgagaatgccaaccgaagaagaacgcacgatccgctgcctgctggcagatatccacgaacccttgaacctgctgttccccggtatccgtgtaaaggccgagacaatgcccttgggctggggagatagtatctgtgccctggtactccgggtgagctacgaacatcgcacgctgggtcgcctggagtacctgcacgaggtccccatcctgcacctgacgcagtggggccgggacggcatgctccagcacctgatgaacgagattccccgtcgggtgctggatggcatgctgcgccaggcacagaaatacagccagagcaactggtacagcaaatgacgactatccgaatcctcgacctcgaaaccgagagctacgagcacaaagggcgcaaagcgtcgccctttgacccccgcaactatatcgtcatggccggctggcgtgacgatgttgacggcaaggtcggccagaaggtggagcatcgcttccgcagccgggccgaagccgaagatccgaacaaccgctggttcaacctcgacggcgtggacgtgatcgtagcgcacaacgccatgttcgaatcgaactggttcttcacccgctaccgggacgagtacctggccttcctgcgacgtggtggccgggtctggtgtacccagcaggccgagtatctgctgagccatcagacgtggctgtacccggcactcgacgaactggccccgaagtacggcggcacccacaaggtggacggcatcaagctgctgtgggaccagggcgtgctcacctcggagatggaccaggacctgctgagcgagtacctgtccggcccgtgcggcgacatcgagaataccgccctcgtattctacggtcagttgatgaagctccaggcccgtggaatgtgggctggctacctggagcgctgcgaggccctgatcggtttctcggcgatggagtgcgccggcctgaaggtggacctcgaagtcgcccgggtgaaccacgccaagcaactggaagaggtggccgggatcgaggctgagctgaagaagctgatgcccgacttcccggaatacttcgagttcaagtataccagcctctaccatatgagcgcatggctctacggcggcgaggtgcggtacaagggccgggtgccctacgaagatggccggatggagaaagccgacttcgtgcgcttcggcacggccaagcgggggactcctatcgagagtacctcggtgcgggtcccgatccacgaagtgaccaaccagggtgagtggcactggcccaccatcaccgagctggcgaccaagcacggcccggtcatcacgttctccgccggcaagaacaagggcagcgtcaaggtgttccgtgaggatacggacatcccggcgaccaagtgggacgatgaccagcgattccgattccccgggctgatcaacctgaacaacctgccggaagtggtgcgcgagaaattcctaggcaagcgcccggagttccagtgcgccctcaccctggcggatggatcgcccgtgttcagcaccagcggcgacgccctccaggctctggagaaacagggcttcgaggcagccaagctgttgatgcgcctggccgagttgcacaaggacaactcctcgttctacatcacccacacctacaacaaggatgggacgatcaaggacacgaaggggatgcttcagtacgtggacgatgatggtatcatccaccactcgctgaatacgaccgcgacggccacgacccgactgtcgtccagccgcccgaacctccagcagctcccgtcaaaggacgaagacgacccggaagccggcagccgcgtgaaggagatgttcgtgtctcgcttcggcgcggacgggatgatcggcgagaccgactataccgccctggaggtggtgatgttggcggccctgtcgaaggaccggaacctcctggcgaagctgatggccggcacggacatgcacttgtaccgcctggcagggaagcacaacaactggaacgggttcgattacgaccagctcgtggccatcaagaaggaccccaaccatccgtggcacggtcgcatgatgcaggctcgaaagaacatcaagcccaaggcattctcggcgcagtacggtgcgagcgcggctggtatcgcattcaacaccggctgtaccgtggaagaggcccaggaattcctggacaacgaggcggccctgttccccgagtccatcgcattccggcagatcgtccgcgacagtgcagaggccaccagcctcgtgatgtacaaggccgaggaccagatgccggcgggcgccttcagcgagatggggtcggatggtaactggcgccagtaccgccgaggattctggcaagcgccgggaggcacctgctacagcttccgccaacaggaacgctgggacaaggaacagcgcaagacggtcatggacttcaaggacacgcagatcgccaactactggaaccagggcgaggctgggttcatgatgaccgtgagcgtggggcgcatcttccgttggatgctgcatcgcccgggattcatggtcaccgagttcctgatcaacaacgtacacgatgccgtgtacaccgactgccacaaggacaccgccgccgaggtcaacaagggcgtgcgcgacatcatggccgacgcggcccgctacatgagcgagcggctgggctacgacatcgccgacgttccattcccggcagtggctgagatggggccgaacatgttcaatatggaggtgatccagtgaaagaactgcatccgctgcacacgcccgagttcgtcaaaacattcctggaccagaccgggtgcctgcctggggtacgccgtacgggccgcaccaccggcattgctctacaggccatcggcatggcgctgtcccatccgagggaaaccctgacgttcgtggaccacccggacggcagctcggcagcactggtggccagcattgaaaccatactggcgaccctgggctaccggaacgtcctcgttcgacccacaacccgtgcggacgggcgcagcgtgaacatcgtcttcaagacgctgccgaacgcctgacgaccttccctactccggccttaaatcttccttcgacacaagagagaccacgtatgactcagcaactcaacgctctgcaagctgcactcgccctggccaacaaggctgccgagaccgcaaccatcgacatgtctgaaacctccaccggcggtggcggcggtcgaatcttcccggctggcaccgccatgggccgattctgcatctacatcgagctgggtgaccacgccaaggaattccagggcaagctcaagaacccggcgcctcaaatccgcctgggcttcgcactgtggggcgacgtgaacccgcaggccggtaatccgcagagccgcccggacgacctgttccacacctacgaggccgacggctcgatcaagcccggcctgttccgtaccttcgagatgaccctcggcaacaacgagaaatcgaagaccaagctcgccttcgacaagatgaactggagcgggcagcatacccacttcgctcagatgctcggccaggcgttcatcatcccgatcaagcgcaccaagatcaccaagggcaacaacgccggcaaggaacgcaacgacatcgattggggcggcatcatgaagccctacaatccggtcgatggcagcccgtacaacgtgccggaactgccgatggacctgttgcagtatttcttcttcgacgcgccgaccaaggagacctgggacgccctgcacatcgaaggcacctcggacaatggcaagtccaagaacttcctgcaagagaccattcgctcggccaccaacttccctggctcggccctgcacatcatgctgggcggcggcgacgatctgatcatcaagccgacgacccaggccgcaggcagcaacctgccggcagtgcccaacgtggccgccgatgcaggcgtagcagcagcccctgctgtcccggcagttccgcaggcagtgccgcagacggcccctagcgtgccccaggtggcgaatgtagctgcccctgtggtaggtactgccgaggcacagaacgtgctgcctgacgtaccgcaggtggctcaggtggcagctccggcggcggtcgaagtcccgtcggtcccggtagtgccggcagtaccgcaggtctaatgcgcctgccatcggaagagttcctggcaggactatccgcgcagttcgaccgcagcatggcaggcgggacgttggtgtgtgacgccgacggacccgcctacgtggctgcggccactgctaagaccttggacactgcactccggagattctggaagctcattttggagcagcagttcctagcgcactgcacggggacacgggttcacctcacggcagcaggtggggcgaaggcgtaccgggacacgtatccgaccatgaaaccctaccagggccagcgcaagggtaaggcaaagcccgcgctgctggagcctctgcgacgggccgtggcggacgtgcatgagcgcggcggcgcacccgaagggatcgatgtcatcctgcacacgttcttcgaggcggacgacggcatgatgatggacgcctacgccatgcaggacaaggccatcatccggtccgacgacaaagacctgcggatgacgatctacccgtattgggagatcgacacggcgtgtgtgagcaggatcgaaggcggcttcggctacctcaaggaggcatacacgccttccggccagttcaagctcaagggccacggacggaagttcttccttgcgcagtggctcggcggcgataccgctgacaacatccgagggatcgatcgattcaacgggaagctctgcgggatgaagacggccttcgatatcctccacccgatcacggacgaggatgaagccatcgacatgatcctggaggcgtacgccaagatcaagcaaaacccgctggcagaggccgaggtgctgtggatgcgccgaacgcctaccgacaacgcagcgcagtacctgttaagccgcgaccttcgtccggccttccgccagtggatcatcgagctggacgcctaccacgaggcgctgctccagaagcggagggagagtgactatgacgagtgagccgaaggtctaccagataccgcgcagccaacagcgcaccttcaccctgaagctgtgggccgagcagggcaagctatgcccgctctgcggtaagcccatcgatatcagcgtgaagggcgaggcggtgatggaccacgaccacgagacggggctggtgcggggcgtcctgcatcgatcctgtaacaccgcagaaggcaagatcacgaacgcggcgggttcctggggatgcaagtcgatgaagtacaccgacatcatcccctaccttcgtgccctcctgacgtacctggaggggccgaagcatccgctgatctaccccctgcacaagaccgacgaggagaaacacgaagcgaagctggccaagcgccggcaggcagccgccaaacgcaaggcggcgatggccgtcgcaaagcacaacgcgaggaacgtatgagcaaactccgcaagcaattcaccaatgagtacctgcgcaacgtctatgtcgagctgggtctcaagaagggcgccgagcatctgaccaggcattcgcgcttcggcgaagtgagccgccagtgcttccgcaactggtgcatcaagctgggcttccacgacagcaggacacgcggcacgtacgccaagaagggtgcgctgcactggctgggccgaaaggcggccgaggtagtgcgcaagttccctggcgccgtgggcaacgtggtcggccaagggccgaaggtgttgagcctggacatcgagacctcgcctatcgagggctgggtctggtcgctctggaagcagaacgtgggcctcaaccagatcaagcgggactggaccatcctgtcgttctgcgcgaagtggatgcacagcgacgaggtgatctacatggactgccagggcgaccccctggacgacatgcacctgctggtcgccctgcacaagctgttggacgaggccgacatcatcatcgtccagaacggcaagcgcttcgacgtgcccaagatcaacgcccggttcttcctgaacaagatgccgccgccacgaccgttcaaggtgatcgacaccttgatcatcgccaagcagcaattcgcgttcaccagccgcaagctggagtacatgacccacaaggcatgcaccatcaagaagcgcctccacggcaagttccccggattcgacctgtgggcagcctgcctccaggacaacccggaagcctgggaggagatgcgcctgtacaacatcgacgacgtacgatcgatggaggagctgtacatcctgatgcgcccgtggttcgtcggccatcccaacgtggccgtgtacttcaacgacgctgagccgactatccgatgcccgaagtgtggcgacacggatgtcaagcaagaaggctgggtgcatacgcagaccggcaagtacgagcactatcactgcggtggctgtggtggctggagccgagggcggtatacccgcaacacctcggaacagcgcaaggccctgctgagcaactaaggaggctatatgagcctggcgttctccgatccctacgaatctacgggcacccagcccggccagtaccgcaaaggcgcggccccggacgagcgaaaggccggcaagctcccgatgcacctggtggttgaaggcttcccgctgctaaagcgggagcttgcccgcatgatgcagtgggccgccgaggtcaagggctacaagccccacgactggaagaagatgtcggtgggcgagttcaaggccgcccaacaccggcacgaatcccaccgcctgctggacgggccgctggatgacgagtcgaacctgatgcacctcgtgcatgaggcattcaacgcaatggccgccgccgagcgtgccttgatggaccgggagaaaggcaatgagtaaaatctgttggtgtacccgaccgcacgagaccgacgaaggtgtacgtgtcatctgggccttcaacgagcggggcatcggggtaaactacgtcacggcgtacgtcacgccggcgatgatccaccacccggactggcgcgataccatcctcccggacatcctccaggagatggcggagcgcctggaccgcgaggttaagctggtggaattgcgctggttccgcgctgagattctgagctgcggggaatggcgtgactaccgagcaatgacgctggacggggcggtcagcctggccgaggccgagtggggtcccgaggatatcgggcgcgtaatcgaaagacgataggagacggaatggacctgatacagcagcagatcgcccacgaagaggcccttgtcggggcggcgcagaacgacgcccgcattgccttggaaaaggcgatagcccaagggtccatcgaccgcatcccgagggcacgcatcatgttgatgcggatgctccccatcgtgaccgaagcgatcttcgcccaccaggaagcgaaggcggcgggaccggcagcgaagctgcgacacctgctgcggatcatcgacgcccaggacctcgcggtcatggcgctacgggccgggctgtcgatgctcatcaactacccaacgatcaccgcgacgaagtattacacccatatgggcaagatgctctgccgcgagatcgaagtgcggttggccttcaaggtcaaccaaccctattacgaccggacgctggactacctcaagaccagcaggactcgcagcgtccggcacatccagaagacgatggacgcccttctggacgcggtactgcccgaggaggcacgtatcgacctgccggatggcgactacctgcgtctcggcaagttcatcggtgacccgctgatccaatgcggcctgttcgagccgaaccgcttcacaggccggggcggtacgagcgtccacctggagccgtcgccggaggccaaggagttcctgcaagacccgtcggcggcgatgacctggggaggcccaggccgtagcgtaatgctggcaccaccgagaccctggaacgactggtgcgatggcgggtactacagcgccaaggcgcagaagcatcacgtattggtgcgtcgtaccaaacaccagaccaagcgggcacgtcagatgcagctccgccacctgggccgggacaagatgcccaaggtatacgcggcggtcaacgcactgcaatcggtggcctacgagatcaaccacgacgtgtacgagatcatcgagcgcatcttcacttccggcggcggcgtgctgggtatcccgcagcgtacctacccggacaaacctgagttcccgctcggcgacgagtgggccaaggagaacgccagtgaacaagagctggaagccttcaaccgatggaagcgatccgtccaccgatggtacaccggggagcgggagcataccgccaagcttcgcgaatttgctgcactctaccgagttgttcgagagcatcatggcaaggcagtgtacttcccgatgcacgttgactcccgtggccgcatgtactattggggcacaccgaatccccaagggtccgacatcgccaaggcatgccttcagttccacgaaaagcgcgccctcggcaagcgcggcctgtactggctcaaggtccacgtcgccaactccctcggatgtgacaaggtgtacttcgacgaccgggcagcctgggtcgatgagcgatgggacgacttccagcgagcactcgacgaaggcccggagaactatccgaatctcttccccgaagacgagtcgcccctgtgcgccatcgccggtctgctggagctgcgggcggcctacgcatcaggccagccggagaattaccgaagtgggttcatcgtccatatggatgcaacctgctccggcctccagcactactcagccatcctccgagacgagatcggcggagcatacgtcaacctgttgccacctggacttgccaaagctgacatctactcccgagttctcggtctcgttgcagagtctctggcacgagacatcgagagtgctgaaggcgaggctcggggctacgctgtactgtgggataaggccggtcttgccaggagcctgacgaagaaaccctgcatgacgctggtgtacggaaccacgttcaagggtgttgtggaccactgcctggactacctggacgagtccggcctggagattcccgagggtatcccgtcataccgcctgggaagctacatggcaacgctcatactggacgcaattcgcgagacagtaccatcggcagtcttcgccatggaatggctccagcggctcgctaaggcccttcctgacgcatccaaggatttgcactggaccacgccactcggcatgcaggtcttccagtcctacccgaagaccgaggaggtccgggtgcggctgcgggccgaggctgtcgagtacgtcaccctgtacgaggccaaggacgagctggacccggtacgcaacgccaacggcatcgccccgaacttcgtccacgggctggatagcagccacctgggcctgacagccctggcatgcgcggcggagggaatcccgatccaggccatccacgacagcatgggcacctatgcggcagacgtggatcggatgcacgtccacatacgggagcagttcatcgccatgtacagtggcccctgtgtgctcgtagagctggcaaatcagcttggggtagaggctaccccgccccggaggggatcgttgaatctggaggctgtacgggactcctgggcgttcttctgctgaggtggattatgtcacccacataggagcaagtgcatccgtccaaggccctcgtagagggagcggggagagaggagaggtcagggaagacctggtagaggagaggtggagatgagaatggatgactacgaaggattctagatagaatagactaaccagcataggagatatgatagatggctactatgaagacccaccgccctacggttatgtcacccacagtggaaggatcgagaacaggcaagggtacggcccgtcctgtcacgttcacctctcagcagatcgagtggttagaacagaccttccccgaacatcagatcggtcctggaaccacgatggaagacatccagttccaggccggcaggcgagacgttgtgcgagcagtacgactgcgccgacgtgatgccatcgcagtggagctgaagtgatgagtaagtccatctggcgagtacacgcaaaggccggcactccctcggaactccagggcctgtgctggctggcaatacaggagctggaggagttcaccctcttccgctcgaaggacgacgccctgaatgcgatgctggacagtatcgagggcaacgatcgaaccgagctgttggtattccgcgatggtcagttggccggcggtgcctgcatcgtgttcgaggacgacccccacgtcggcccgtgcgtcacagcacagtggcagtacgtcctaccgcgctaccgcaatacaggcgtggtccgggagttcatccgcgaactccaccgtcaggccggctggggtcaaatccccctcgtgtgctggagccatcgtgaaagcgatagccggtacacgatccactaccggagagccaagccttatgggcaagaaagtcaagaaggtgctaggcaagaccatcatcggcaaactcgctgatggcctgctgggcaccgaccttagcggcgcacaatccgatgcccgcaagatggaagagcagaaccgcctaatgcagcagcaggcggaccagctcgcacgaaaccagcaggttgacctcaccgccgagaacgtggcgcaggttgacctaggagcgatggccgatgccactggcaccggcactcgacgacgccggaatcaggcgggcacaggcgtatcgcaaaccctcggtatcaactactgacgaggtacgccatgaaaaccaccgcagctatgctgtgggagaaacttcgggatgggagcgtggagagtcgagccatcgagttcgccaagaccacgctgccctacctgatggtcgatcccatgtccggcagtcggggagtcgtagagcatgacttccagtccgccggcgccctcctggtgaacaacctcgccgccaagctggcgagatcgctgttccccacggggattccgttcttccgatccgaactcactgatgcgatccgccgcgaggccgacagccgggacacagacattaccgaagtgaccgctgccttggctcgggtggatcgcaaagcaacacagcgcctgttccagaacgcctccctggcggtcctgacgcaggtgatcaagctactgatcgtgactggcaatgctctgctgtaccgagacagcgccgccgctacggtggtcgcatggtcgctccgctcttacgcggtgcgccgggatgcgactggccgctggatggatatcgtcctcaagcagcgctacaagtccaaggacctggatgaagagtacaagcaggacctgatgcgcgcaggccgcaacctgtccggttcgggcagcgtggacctgtacacccacgtacagcgcaagaagggcacggcgatggaatacgccgagctgtaccacgagatcgacggcgtgcgtgtgggcaaggagggccgctggcctatccacctgtgcccgtacatcgtgccgacctggaacctcgcccctggcgagcactacggtcgcggccacgtcgaggactacatcggcgacttcgccaagctgtccctgctgagtgagaaactcggcctgtacgagctggagtcgctggaggtcctgaacctcgtggacgaggccaagggtgcggtagtcgatgactaccaagacgccgagatgggcgattacgtgccaggcggtgcggaagccgtccgtgcttacgagcgtggcgactacaacaagatggctgctatccagcagagcttgcaagccgtggtcgtccgcctgaaccaggcgttcatgtacggtgccaaccagcgcgacgccgagcgcgtcactgccgaggaagtccgcatcactgcggaggaggcggagaacacgctgggcggtacttactcgctcctggccgagaaccttcagtcgccgctggcgtacgtctgcctgtccgaggtggacgatgcgctcctccagggcttgatcaccaagcagcacaagccggctatcgagacgggccttcccgccctgtcccgctccgccgctgtgcagagcatgctcaacgcttcccaggtcatcgctggcctggccccgattgctcagctcgatccccgcatctcgctaccgaagatgatggatacgatttgggcagccttcagtgtcgatacctcgcagttctacaagagcgaggcggagctacaggccgaggcagaacagcagcgccagcaggccgcacaggcccaggcagcgcaggaaaccttgctggaaggcgcttccgacatgaccaacgcactcgcaggagtctgatagatgacccaaccgaacgaacagcaactgccgccgggcctcgctaacctggttgccaacgtaccgcctgccgccgcaccgaccccgagtcatgtgcaggtgatgccgaacccggtgatccaaccgcaggccccggtccagcccggccaggtaggtgcgccgcagcaactggccatcccgacccagcagccgcaacccgttccgaccagcgccatgacgccgcactaccaaccggtagcggcacctgccgtgggtcaacccgttgttccgcaagcacccgctcagccggccccggtagctccgccggctgcgggtgcagttcttcccgagaacctggaagtcccgccgccgccggccttcactcccaacggggagatcgtgggcaccttggcagggaacctcgaaggcgacccgcagttggcgccctccatcagctatctggaggcgttctctgacaaactggataccgtccgagccttcggcaaggccgccgagaaccgcgatcctcggttcatcgacgagcactatctgaaggaagttctcggcccggcccaggcgcagcacgtcatcaacgtggccaagggcgtcctgacctatgtcgatgcgcaaaccaaggctgtcctgaaccagacctatgccgccgtcggtggcgaggccgtgctgaagcaggccgcaggcgtcttcaaccaacacgctgacccggccaccaaggccgccatcggtcggctgatggactctggcgatgcccaggccatgcagtacgcagcgaagcagatcattgccttcgcacaaggctccggtgccgttgtacaggctaccggccaacccctgggtgctgcggcacctgcactagcagccctgaccgctgagcagtaccgcgcagaagtgtcgaagctgccgctgaacgcatccgaagccgacatggctgcactgcgagagcgccgtaaggcaggcatggcgcagggtatctaacgaccctgccctactccggccttaaactcacatccaaaagagagagaatcgcatgagctttctgaacgacctgacccgtccgaactacgctggcaaggacgcggacgttgacatccacctggaagagcacctcggcatcgtcgacaagcacttcgcctacacctccaagttcgcaccgctgatgaacatccgcgacctgcgtggctcgaacgtggtccgcctggatcgcctgggtaacgtcaaggtcaagggtcgtcgcgccggtgaagagctggagcgcagccgagtcgtgaacgacaagtggaacctgaccgttgacaccctgctgtacctccgccaccagttcgaccaccaggacgagtggacccaatccttcgacatgcgcaaggaagtcgccgagctggacggccaggaactggctcgcaagttcgaccaagcctgcctgatccaggtgatcaaggctgccgcgatggacgcaccggtggacctggaagacgccttctcgccgggcgtgctggagaagctggacctgaccggcctgaccgccaagcaggctgccgagaagatcgtccgcatgcaccgccgcgtagtcgagaccttcatcgaccgcgacctgggcgatgcggtctactccgagggcctgaccccgatgtcgccacgtgtgttcagcctgctgctggaacacgacaagctgatgaacgtcgagtaccaggcaaccggcgcgaccaacgattacgtgaagtcgcgtgtggccgtcctcaacggcgtcaaggtgctggagactccgcgcttcgccaccgacgcaaacgcagcgcatccgctgggccgccacttcaacgtgagcgccgaggaggctgagcgtcagatcgccctgttcctcccgagcaagaccctgatcaccgcccaggtggcgccggttcaggccaagctgtgggaagaccacgataagttctcgtgggttctggataccttccagatgtacaacatcggtgcccgtcgcccggacaccgctggtgccatcgagctgaagggtatcggcgccttcgacatcaccgcgtgatgccacgaaaccccgcacttcggtgtggggtttcttcaaagcctaacgacccgcgcagattccctgcgtgggtttttgcgctttaggagaaaccctatgctactactcgacgcagtgaatgtcatcctgcgcaagatcggcgagctgccgatcccgagcatggatgagacgtatcccaccatggccattgccctccctgagctggaggaccagcgcatccagttgctgacgcaaggctggtggttcaacacctggtggaagcacaagctgacacctgatcccacgggccgcatcaacctgcccaagggcaccttggcattctacccggattccccggacctccagtgggacggcctgggagtgcgcgacgccaacaccggcgacgaccgcatcggtaagtcggtcgagggccggctggtgctgtcccgcgagtgggaccgtatccccgagatcgcacagcgcgtcattgcgcaccaggccgcactcgcggtgtacacccacgagattggcccggacgagaccgcccaggtcatcgcccaggaattgcaggcgtatcagaacgaactgtcccgcatgcacacccgatcccgtccgctgaacacccaggccaagcgtagcttcagccggtggcggcgcagcttgaggacctgagcatgagctacaagcaatccgcgtatcccaatctgctgatgggtgtgagccagcaggtgcccttcgagcgcctacctggccagctcagcgagcagatcaacatggtatcagaccccgtgtcggggctgcggcggcgcagcggtatcgagctgatggcccacctgcataccgaccaaccctggccgaggccgttcctctaccacacgaaccttggtggccgcagcattgcgatgctggtggcgcagcaccgtggcgagctgtacctgttcgacgagcgggacggtcgcctgctgatgggtcagcccctggtgcatgactacctcaaggccaacgattacaggcagctacgggccgccacggtggccgatgacctattcatcgccaacctgagcgtgaagcccgaggccgaccgcaccgacatcaagggcgtggaccccaacaaggccggctggctgtacatcaaggcgggccagtattcgaaggcattctccatgaccatcaaggtcaaggacaacgccaccggcaccacctacagccacacggctacctacgtgacgccggacaacgccagcacgaaccccaaccttgcggaagcgcccttccaaacgagcgtaggctacatcgcctggcagctctacggcaagttcttcggtgcgccagagtacaccctgccgaactccacgaagaaatacccgaaggttaaccaggatgccgatgcggcaaccatagccggatacctcaaccagcgtggggtgcaggacgggtacatcgcattccggggagatgccgacatcaacgtcgaagtgtccacggacatgggcaacaactacggcatcgcgtcgggcggtatgagcctcaacgcaacggcggacctgccggccttgctgcctggtgcgggcgcacccggtgtgggtgttcagttcatggatggtgccgtcatggccaccggctcgaccaaggccccggtgtacttcgagtgggactccgctaaccgccgatgggcagagcgggccgcctacgggaccgattgggtcctgaagaagatgcccttggcgctacgctgggatgaggctaccgacacctacagcttgaacgagctggactatgatcggcgcggctccggcgacgaggacacgaaccccacgttcaacttcgtcacccgaggcatcaccggcatgacgaccttccagggtcgcctcgttctcctgtcgcaggagtacgtctgcatgtcagccagcaacaatccgcaccgctggttcaagaagtcggcagccgcgctgaacgacgacgatcctatcgagatcgccgctcagggcagcctgaccgagccgtacgagcatgcggtcaccttcaacaaggacttgatcgtcttcgccaagaagtatcaggccgtggtcccgggtggcggcatcgtgaccccgcgaacagcagtcatcagcatcaccacgcagtacgacctcgatacccgggcggcacctgctgtgactggacgcagcgtgtacttcgctgccgagcgtgccctgggtttcatgggcctgcacgagatggccccgtcgccgtccacggacagccactacgtcgccgaggacgttaccagccacatcccgagctacatgccggggccggctgagtacatccaggcggcggcctccagcggctacctggtgtttggcaccagcacggcggacgagatgatctgccaccagtacctctggcagggcaacgagaaagtccagaacgccttccaccgatggacgctgcggcatcagatcatcggcgcgtacttcaccggcgacaacctgatggtcctaatccagaagggccaggagatcgccttgggccggatgcacctgaatagcctgccagcccgcgagggtctgcaatatccgaagtacgactactggcggcgtatcgaggcgaccgtcgatggtgagctggagctgaccaagcagcactgggacctgatcaaggatgcctctgccgtataccagctccagcccgtggccggtgcctacatggaacgtacccatctcggcgtgaagcgcgagacgaatacgaaggtgttcctcgacgtgcccgaggccgtggtcgggtcggtgtacgtggtcggctgtgagttctggtccaaggtggagttcactccgccagtgctccgagaccacaatggcctgcccatgacctcgacccgcgcagtgcttcatcggtacaacgtaaacttcggctggaccggcgagttcctgtggcgcatcagcgacacagcccgacccaatcagccgtggtacgacacgacgcctctgcggttgttcagtcggcagctcaacgccggggaacctctggtggacagcgccgtggtgccgctgccggctcgggtcgatatggctacgtccaagttcgagttgagctgccatagtccgtacgacatgaacgtccgggctgtcgagtacaacttcaagtccaaccaaatctacaggagggtgtgatggctttctggctaccactattggccgctggcggcatgtccgcccttcagcagggattggccaacaaggaagagcgcaacaagatcaaggccgagaacaaggctcgactgaagacggacctcgacaacctgggcgccgccgcccgcgacatcgccaacctcggagtcatggccgctagctaccgcaagcaggccgtggcctcgcaggtggaggccaaacgccaggggatgctcgccggcggcagtgccgaggctcaggccggagcgttcggcgtcaagggcgcatccgttgatgcggtggccctggatatcgagcgggaggtcggcgaggctctgttccagattgacgacaacctggacaatcagatgtggaacctcgccgagcaggcgcactccatccaggcccaagctaaggccggcctgctgggacagaagagcaccactgcggggcaacgatccccgctggtggctggcctgatgtcggcgggttccctgtatgcaagtcaatacttcaagttcggcgccacgcctaaaggaggcaactgatggcggaatcgcaacgtgcttcccaagagcttgggatcaacgtcgggcagacgcaactccagccgggccagagtgcccggcgtggggtgcgcgactccgaagtcaactacagcgggccgagtgtaggctcacagattctcgacggcatcctcggcgccggtcagcaaatcgcaggcaagtggttcgagcacaacgtgcagcaggaagtgctgcgcggtgagcgtgcccgcatggccggcgaggccgaggaggcggtagacagcaacatcctggccaagcccttcgtgaagggcggctggcgtaagcaggactaccgtatcgctcaggcggacttcagcctgaagatgcagcagttcatcgccaacaagggccgggagatgactcccgaggagttccgcaaatacctgtcccaggaggctacgcacgtcctggactcgacaaagggcatgaaccccaacgacgccctacaggcgctggcgcagcagcagaaggccgaggagcagctcttcggcatgcaggccaaggcgtacatggactggtccatcgaccaggccgcacgaggcttccgcacccagggtaacagcatcctggccaaggctgtacaggcccaggccaccggcgacgaactgtcccgacaactcagcctggaagaggctggcctgttctataccaacatcatgacctccgaggatatcccgctggaggtgcgtgacaaggtgggcatgcagttcctggcagccagcctggacatgaaccagcggggcatctacgagagtctgcgcgatgccggcttcctggacagcatgtccttcgacgaccggcgtgcgctcaacggcctctatgaaaagtcgaaggcacagacccgggccaaggaatcgatggctaccctgcgggccgatgcggacttccagcagcgggtggctaacggggccatcacagaccttgccgaggtcgaggcgtactcccggggcatggtcgaggagggccgctggagcgacgcccaggccatctcgttcatgaccaaggccatgaccggcctgggcaacgctcagcgcatgcagggcatcatggcggccctggaggctggggacatcaacgccctgcacacgctggggacgaacgtctccgaggcactggagcagtgggacaagatgcaggcggccaacggctcaagcctgaccgatcgactcgtacagggcacgcagctcggcctgcgcctggggaccttccccaagacctacggcgagtccgtgggcagcgccgtgcggatgatccaggcggccaaggaaggcgaggcgaacccggagctggtcaatacgttgaacagcatcttcgagcaggtggcctcggcccaggagatcaacccctccgccggcaacgtgatgctatccggcatcccggaagccgagcagggcgctgtggcctgggcactcaagcagatgaagatgggcatcgccccagctcaagcactgcgcgagttcagtgccaacgccgaagtcgtgaagcagatggacgagttcgagaaaggacagaacaccaaggcattcaaggacaacctcggcaagcaggtcaacgacaagttcgtgaacaacatcttcggtcgggcctggaacatgctgaccggtgagagcgacctgagcaacaacgaggccgttctcagcatgtaccgtcgagcaaccatcgacgaggcgaactggctggccagcgaccgcaagcatgcgggtctgcttaccagtgacacgggccgcgaggccctgctggagatcgccgccgccaacgtgcgtaaccgcaccatccaggtaggcgaaggtcggaacctgaaggaaggggacctgttcagccgccgcgacagcgcgccactgatcctaccccgtggaaccaccgccgagcagctattcgggaccaacgataccgagaccatcgggaccgtcctggccgagcagcacaagccgcatgtcgaaggactcctcggttacaagtcggtagtcgccttcgagtacgaccgcaccagtggcagcctcctcgccgtcgagtacgatgagaacggtgtggccctggaccgcacgcgggtcgatccccaggcagtcggtaacgaggtgctcaagcgcaactcggacaagctgaacgcgatgcgaggtgccgagtacggtgccaacgtcaaggtcagcggcacggacattcgcatgaacggtggcaacagtgccggcatgctgaagcaggacgtgttcaactggcggaaggaactggctcagttcgaggcttaccgaggggaggcgtacaaggatgccgatggttatagtgtgggcctggggcattacctgggcagtggcaatgctggggcaggtactacagtcacgcctgagcaggccgcgcagtggttcgccgaagacaccgaccgcgcactcgaccagggtgtgaggttggccgacgagctgggcgttacgaacaatgcctctatcctgggcttggccggtatggccttccagatgggcgaggggcgtgcccggcagttccgtaacaccttccaggcgatcaaggatcgtaacaaggaagccttcgaggctggcgtacggaacagcaaatggtacacgcagacgcccaaccgggctgaggcattcatcaagcgcatggcgccccacttcgatacaccgagccaaatcggggtcgattggtacagcgccgcaacagcggagtaagacatggcacagcaattcaagggccgcatgacgcccaagtacccacttgaccaagcacagctcgacgaggcccaagtacagggccaactcgacgcagtgcctaccgtggggttcgacgccctgacgggtggcgagatcggagaacggaacgtggcagcgggccaacgagccaacgcgcgggaactggaacgcatcgtagcggaccaggaactgccggcccttgaccgtgcttccgcactctggaaccagtccaccctcgtcggacgctggggcgatgcgctccagctcgacgcggaccttgcggcgaacagcaccggcgaggtggaccccaacttcgacgccgggacctacggggtccaggcgctccaggcggcgggtatccagccgactgacaactatctccagatcatggcccgtgccggcaatgccgaggacgcggcctacctcctgtcgaggattcaacggtatgagcaggacgagcaaatcgtgcgggacaacccgtactggaacttcgcggctggcatgctggaccccgccgctctggcagttgatgcggttactttcggcgctggccgtgctctgcggctcggtcgtgctggcatggctgctgctggcggcgctgggcaagtcgggtatgttgctgggctggatgccgcaggggccgacgtggatgccggaacctacatcgtggcaggtgctcttggcgctggcgtgggtgctctgctggggtctggtgcgggacgcattgccgcagaggccccaacgcaaccgcatgtgcccgaagtatcggcgcctactgtcgggctgccagaagtagccatgaccgccgaggaggccgccgcacgcggcttcaaggccggtgacgtggtagacctgctggacgagggcaccgtgctgtcccgtgtcagctcccgtgtggagcaggccgagataccggccatcccgcgccgtgacactgccttcggcgacgagctgcacagcctgtcgggccggaagctgtccgaggtcctggaccacctcaagacccacgcagaggttcccaagccgctccagggcatcgccgccaaggtggctgataccatcaggaccctggagggcctgggccagcgaaccgcgttccgagtggtgcagggtggcgacactgccagctccgcattccttaagccgggcacggcgggcatccactccacccagggcctcgacaccttggtccaggtacgcggcagcaccgcacctggtcgagttggcaccaacccggtgaccgtgctccacgaggcggtccacgctgccaccgtaggcgtgatgaacgccgccctgcgcaaccctggcgcgatgagtccgaaggtggctcaggccatgcagaccctggagaacgtccggggtaacgtgctcaacgccctgaagcaggaccgcgccgccggtcggcaactgtccgagttcgaagagacgctgctggccggcaactccaacaccctggcaaacgtcaaggagctggtggcctggggcctgacggatacccgcttccagcggaccctgaatcgcctccgctacagcgacggcgggccgggcctgtggacccgtttcgtggagggcatccgtagcctcctgggcctccggtctgatgccgacacggccctgagtcgcgtcctggccgcctctgagacgatcatggacgccatgccggggtacactaaggctcaggctaagtgggccaacaagggcgctccggtgaccgaggaggccagcctggagaccatcgtgcggaccaccagggagcgtgcccgcgagggtgcgggcttcgtgaaccggttcttcagcgaggcggacctactggcacagcccggagagggcgcacggcgcctcctgagccgtcttatcgacgaccctgtacgtcgggatgggttcagcacgaacgacaacgcagcgagctatttgcgccgttaccggaacgagttcgagggctacgtgaagtcctacgacgagatgatggccaaggcaatggctgagcagggcgtgggcctgacggcacgtgcgctgaactcccgccgcgccatggcagtccgggaccagcttaacgagcaggtcacccgcgagctgctgcgccgggaccgggagtggaccgcctacggcagcgtccgcgtagaccccaacctgccgccgaccatcaaggccctggccgaccgctcggacgagattcacggtctgatgggtcagcgtgccagggaagccggggtccggggcttcgaggacttcgctccgcgtcccggatacttccaccgctcgtggaactggtccaagatggcgcagatggatgaggccgcccctggcctggcccggcgtgctatcagcgaggccgtgttccggggcatccctgggctggagcgtgccgacgccgacaccatcgcacaggccattgtgcagcgggcacgggaccgggctaccggtatccgctccgagttcatgggcgcgatgggcgtggcggacacggcattcatccggcaggcgctggaggaggccaacgtgtcccaggccaagttcgacagcatcatggccaagatcgagcagaagcagtccgaccagggcaccgtcaaatacggcaagggccggctgtcgctggacatgaccgccgagatcaaccacaatggaaccgtgtaccgcgtgcaggacctgatcgaccgggacctagaccgcctgatggagaactacgccggcagtatgtcgggccgctcggcactggcccgcgcaggcatgcccggcgactccgaggtggaagccttcatccgtgagtaccagcgggaggccgcgcacctgggcaccgacaaggtgcaggagctgacgggccaactgcggggcgtcttcggggacttcaccggcaacgtgccgcgagagcatcagctcggccccgtcgcacagcgggccagcgggctgaccagcgccaccatgctgggattctccggcgtgtaccagcttgctgagctggccacgatggctcaccgccagggcgtcttcaacgtaatgaaggccatgctgaactcccgcctgggtgacttcgtaggtgccatgcgtcgagacccggacctcgctgatgagatgcagaccgtcctcggcctgaacctcgccaacgacattcggatgaagccctggaagcggcagttcgacaccttcctggccagccaagacaccttcatggatcgcttcctccacgcgggtaagcaggctgtcccggtgctcaacggcatgaagttcatccacaactggcaatcccgcatgaacgccaacctcaccttgaacaaggtggcgcgggcggcgcagggggatgaagcagcccttcgcgtgcttcagcagtacgggaaggacgtggactggacgccagtcctggcgcgggttcgcggttatgtcacatacagaggaaggaacgcccaatccatgaattggggcgcctggagccaagcagacgtgaacaccgtcatgaacaccgcattgcggatcatggacgactcactgctgtacggtcgagtcggtcagaactcgggctttgcccggtcacctgtcggccaaatcctggggcagttccgcagctttgtggccttcgcgcacaacaagctcctccggggaacctatgagaactccggcgtgcttggcgtggcctcgctcctcgcattccagtatccgctcaccgcgctgatgatgggtgccaaggcagcgatcaacggcaagttcgacacctctgatgaaggcatccgcaagatggccatcgacggcatcggttacactgccggcctcggcttcaccgccgacatgtggggcgtgatcaccggacactctaggatgtccgccccggtcttcggactggcggagcactccaacgaggtgttccgtggcgtcaaggacctagtaaccggcgacgaccccgcagccgccaccggcgatatcgtcaacggcgccgcaggggcactgcctttcgtcaacgtattcccggcgaccaagttgctgctggaatccatcaaaggggaataacgtggctcggttcaagaatcccgagaccatccacgttgcagatggggtcgaggctgtcttcagtctcgacttcccattcctgcggcgtgaggacgtattcgtccaggtcgataagatactcaccaccgactatacgtgggtggacaacaccaacattcaattggccgtggtgccgaagcagggccaagaggtccgcatcttccgcgacacgcctgcccaggtcccggacactcagttcagccagggcatcccattcctgccgcgctacatcgacgcgaacaacaagcagctcctgtacgctgtgcaggagggcatcaacaccgcgaacctcgccctggatggcgtactcgacgcgatccgtatcgccgaggaagctcgccgcctggcacaggaagcactcgacgccgccaatgaggcgctgcgccgtgccctgggcttcgctgagattcgcaccgtgaccgaggactcggacatcgatccgagctggcgtggttactggaaccgctgcatcaccgctgacaaacccctgaccttgaccatgcagatggaagacccggatgcaccctggatcgagttcagcgaggtccacttcgagcaggcaggcgtgcgcgacctcaacatcgtggccggccccggcgtgaccatcaaccggttgcagaacaccaccatgcagctctacggcgagaatggcgtgtgtaccctcaagcggctgggcgctaaccactggatcgtgttcggagccatggaggacgaataatgcgcggcattatcgcgggcatcatggcctcccaaatccggcgtccaaaaccaatcctggcgacgtacccgtatcccatcctagctacagacgacgcatggtcctgccggcccaacatagtggcggcgctgacacgcgacactctgcacgaggttgtgaaccagccaggagaggacacctaccacgcgacctccagcgtggtaagcgtactgctgcggtcgctgactcagctcggctacggcggtggcgatgggttcctgaccggacctgccgtcaatgcagccttgctgcgcgatacggtgaaggaatataccgcagagccttacgcattcctgtcgcagaccgcagtggccggcgcagaactgaaggttgtggttgtatactccgagtatatcgtggagccgtacgccttcgccacctcgacagcaattaaacaggcggaactgaccaatgtttgagacacgagttaagggtcgctacaccgtgacccatctgaaagccacgggtgaagtcctggcacagtacaccttcgacaacctcatcactaacgcgggtctcgactggatttgcgccatggacacctcagacctgttctcacaggccctggccgtgagtaccagcacagcagaccccaaccccgctgcaccctccctgccggaggaagtacgacggaccacctcgtacgccccgaacggggatgttacctcgggtctggatggggagtggatttactggcacaagcggtggcgcttcccgataggcacccttaccggacaggtactggccaccgtgggcatcgtggcccaatccgaagttgggttcgagagtaacaccggcgcgaagattccggcagggactccactgtcctacacccggatcaaggatgccgccggccaacccaccaccctggtggttcaggccgacgagattctcgacgtgcagtatgagctgcgcagcaaggctgtggcgatggccgaggccaagttcgtgatctctggagtcgagcgtaccatccgccttactccgctgcccttcgcgaaccggcgtaacctctacggtgagcgctacatcttctacaacgagagtcctcggattgacggtaagaatgcgtccggctcggatgtccaggatggccagtgggtgaagctgtacccgcgatatacgcggggcacctacaaggggcagctaatgctgcaggccaccgttgataacggcaacatgccgggaggcatcaccggctgcaaggacctgaagatttacaacggtcggaactacgcactcaccatcgacccgcctgtagtcaagaacaacacgcaggaattctccatcacgatggagttctcggtagcgagggcataacccatggcactgatctacgacttcaacctggacctcgatccgaaggctaagtccaagttcgtaggtgcgcgaggccgtagggacatcagcgacgtgctagacttctgcgacgggggcgtggccatccaggacccgtcgcagggtatgatggtccgcgtgtggcgaacagagcttcgccaggacgggacctacctggggcacgaggacggctcgaacgagattcgcatcggcggaggtatcgaagaaggtatctccacgatgtccctcgacttcgacagtaacatgaactacgtgtgtgctttcgtacgagccgatcgaactggtgcaatctcctacttcaacgtgcagcagggccgccggctcctcgtggagcttgggcaggttgactatgccaaggtggccttggacgataagcgtcctggagctactgcctgggcacaggtcatcgtaccttacacccgtaacggcaacctgtacgtccgcacacagaacgagaactatacggtagagcacctggaggtggataccggcaaggtattccgaccgctggtcaaatgcggtatgggcaccaacctccgcttccaagtccaattcagagggcacatgtaatgagcaaaaagcagaccgcgagtgctgagcggctgggcctgctacacgagctggtctgcaccgctatcgagcgcaacttcaagtggtacatggacaacgacatcccgatccccgcatcggatatcgctgccgccaccaagttcctcaaggacaacgagatcacctgtgatccgtccgacaccatcaacatcgaccggctccgcgaggagatgcggcaggcgcaggccgagaaccgccgcattgccttggagggcttcatcgccggtgagaccgacgacgagatggaacgcctgtacacccactaaggaggcagcatgacgccgcaagaacgattccagatagcccacgaagtgcgggacatgtacccgcgcttccgggacttctgcctggacgccatgctgttcctcggcttcaagatgacgtggatgcagctcgacatcgccgacttcatgcaggattcgcccaacaaggcgatggtcgctgcgcagcgtggcgaggccaagtccaccatcgcctgtatctttgtggtgtggtgcatcgtccagaacccggctacccgcgccatgctggtatccggctctggtgacaaggctgaagagaacggccagttgatcacgaagctgatcatgcactgggacctgctggcgtacctgcgccccgaggcccgaatgggtgaccgtacctcggccaccagcttcgacgtgaactgggcgttgaagggcgtcgagaaatcggcctccatcaactgcatcgggatcaccgccgccctccagggttaccgtgctgacatcctaatccctgacgacatcgagaccacgaagaacggcctcaccgccaccgagcgggccaagctgacgcggcagtcgcaggagttcacctctatctgcacccacgggaagattctgtacctgggcacgccgcagagtcgcgagtcgatctacaacggcctgcccgcacggggcttcctgctgcgcatctggccgggccggttcccgaccctggaagagcaagagcgctacggcgactggctcgcaccctccatcctggcacgtatcgcccgcctggaggagaaaggccacaacccgcgcaccggcaagggcctggacggcacccgtggctggccggcggaccctcagcgctacaacgaagaagacctgatcgacaaggaactcgaccaaggccccgagggcttccagcttcagtacatgctggacaccagcctcgccgacgagcagcgtatgcagctcaagctgcgcgacctgctgttcatcgacgccacgcatgagagcgtacccgagcaagtggcctgggctgccgacgagcgcttcaagctcaagttcgacgcccaccgattcccggtcatcaagcctgagctgtacctgccggcgctgatggctggcggctgggcaccgctccagcagatgacgatgttcgtggaccctgccggcgatggtggcgacgagctgtcgtatgcagtaggcggaactctcggcccgtacatccacgtcgtgagcatcggcggctggaagggtggatttgccgaggagaacctggagaaatgtattgccctggctgcgcgttacggcgtcaaggtgatctatgtcgagaaaaacctcggcgcgggtgcagttggccagctcttccgcaaccatatgcgatccatcgacccggacaccaacaagccccgctatgaggggatcggcgtagaagaccgccagaagtccggccaaaaggaacgtcgcatcatcgacaccctgcggcccatcatgcagcggcaccgtctgatcttccacgtctcggcgatggattccgaccacgtgtcctgccagcaatacccagcggacaagcgcaacgagcgctccgtgttccaccagattcacaacatcaccaccgaccgaggctcactgccgaaggacgaccggatcgatgcccttgagggccttgtccgcgagctagcacccacgctcgtaaaggacgacgaagccgcaacccgcgctcgtgaagaggctgccaagaaggaatggctgaacaacccgatgggttacactaagtctgtccttcggtctctcggcatgggccgggagcgtcgcaagggccgcccaaaaggacgaagactatgatgctcgataccgccaccgaggcgggcaaaggcaccctcgccgtcaccggcgtggggattgccgtttactcgccctatgagatcgccagcctctgtgctgcggtactcaccgcgctctacgtgggcgctcagctcatcaccctactcccgaagatgctcgatagcatcgcggagcttcgccggaggttcaagaagtgaacaagcccctgcgcggcgcagcccttgcggctgccctcgccggccttgtcgccctggaaggcagcgagaccaccgcctaccgggacatcgccggcgtacccaccatctgctctggcaccactgccggggtcaagatgggcgacaaagccacaccggagcagtgctaccagatgacgctcaaggactaccagcgcttcgagcgcattgtcctggacgccatcaaggtgccgctgaacgtcaacgagcaaaccgccctgacgttcttctgctacaacgtgggtccagtctgtacaaccagcacagcgttcaagcgcttcaaccaaggccgcgccaccgagggctgccaagccctggctatgtggaacaaggtcacgatcaacgaccagagggtcgtatccaagggcctcgtgaatcgccgcaacgcggagatcaagcaatgcctcgaaccatcgtcgcaatactcgtccttgctgtggtagccctgggagcctcatacggcttcgtccagagctaccgagccttgggtatagcccaggaggagatcaagcgtcagacggcccgtgcggaggccctggaggtgcgttacaccaccttacagcgccacgtccaggaggtcgccgccaagaccaacacccagcgccaggaggtggaccgtgccctggaccagaaccgcccgtgggctgaccggcctgtgcctgctactgtcgttgacagcctgtgcaaccgccccggcgcccgctgtgctgtgcgaacaccctctgattgaccctaccacccaggctggcctaatccgcgctgtagcggcctatcaggacgccctggacctatgcaacgccctgaatcaaggagactgacatggcgaacacccgtgatcaatacctcgctggccgtaacaccggcctgaccttctaccaggtctgccagcccggcaccgacaaccgcatcgccctgcacgacatggacgaggccgatgtcaaggctaaggccaccgctgtgattgcagcagcctctgccctgggcggcgagggtggcgctactccaccggacccgctcaccgcctacaaggtgaagaacggtgacaccctgcccgtggacggcggtggctccgtgaaggtgaccgtagccaacggtgccatcaccaaggtcgtgtacaccgcaccggcgggctgagctacagcccgtccaacctgatccacccataacacaaggaactgaaccatggcaaccttcgccgctgcaactcagaaagacctccgcgccttcgccggcaccatcgagaacctgatccgtccgctggaggaagcggccctgggttctggctacaacgagaccaagctgcgcgctgaactggtcgcgcacctcgacgagctgatggctgctgtcgagactgccaaggcgctggtctacaagtgatcgacgagtagctcaagccgagcacctgcacagtcgggtgctccactggaactactggaatttttattgagggctggctgtgggtgggagttggtagtggtgggcgggagtagttactccgggtctaattttggtatcgtcgtgtgagaaccctcccgactctgatcagcccacccttcccccgtaggccctccgcctggtgggccactgcctcgcattgcctgggtgttgcctgggtcatccctgggagcttccagctacgctgggtggtggtgggcttccctgccctgtcgctgtcctgtcgccgcccattctacgcatcctggcgggagtgtcaacccctgggtggtcggtgccttgctcggctacgctccagcgcttccgcgtggtcggctaggcggttggctcgccagcgcttcgcccactctacacctcgctccacctcggaccacttgtccgccagcatcatgcgctgccatgccgcgtcctgctgtagccatgccctgctggctctgtcctgtctgctcagcatcctctgtctcctctgtctggctccctggggcttccctggggcgctgctgtggtcctgtcgggtgatggtgcgggag

SEQ ID NO: 17 - DNA, 43744 bp, Podoviridae Phikmvvirus
  misc_feature (1)..(43744)
tggcgggctggtctgtggctggcatctggctgggagtagttactccgggtccaattttgatatcgtcgtgtgagaaccctcccgactctgatcagcccacccttcccccgtaggccctccgcctggtgggccatcgcctcgcattgcctgggtggtgctgcctgtcctcctgggagcttccggcttcgccggggtggcggtggcttccttgcccttcgccgcccattctacgcatcctgccgggagtgtcaacccttgggctatcgctgtcactctaccgggcttggccgtagtgcctggagcgctctatcgcctcctggtgcctggctacggctagcgctcggtctgcctctagggtcctggctacgcctgggtagtgcctggcatcttccctagcccacttggctagcctgcgctgccaagctgcctcgtgctggtgccaggctcgctcggctcggtcctgtctgctcagcatccttgtgcctcctgtggtggtctgcggtcctgtcgggtggtggtgcgggagtggctggccttgcctctacgctctgccctgcctcctgtgcctggcattgcctcctggctctacctggcgttgcctgggtggtcctggctctgcctggggcctacctggccactccctctaggccacgtactctactcgcctgcctctgccttgtctagtccctcctggctggtgcctgggtgctggtctgtctcacctggctcactctgtccctacctgtgccctgcctggctctgtcctggctaccgctggtcctgctgtcttgcctcgccgctccctcgcctgctcggtcgcacctgcggcgctgatggactcctgtttgtccattgtgtgtgacataaccgcagccttagtgccatgcgggttccagggtggtaggtctggctggtcgggtggtgcctgggtgatgggctatcgctccctggtaacgcaaatcctggctagctagactaagcctcgcgcatggggtctctatacgcgtggggctcctggcagggccataggagggagttgacacgtaggcggtaggtctgtagagttcgccctgtcttcacgcaataccgccttcacaggcagcctggagacagggttgacacactgccagggcatcggtagagtgcgcagccagaacgacgggagattgcaaccttccaagcgcggcacaagccataggcgcaagggacacggcaaactcttagggcaggaaccgcagtgtgtaaggccggcaggcatcactgaggggattgacaaggtaataagatgcggtaagatgtgcggcgtcaagtggtcccgatgtacacactgtgaagggattacggcgcggtcagacagatgaccggcaccgcttgacactgtaaagctcagtcggtacgatgggcacccatagcggacgtgatggtccggggcgatgcggataggacgccttgtttataacctgaccgcaaagctgtgactccagccgataggactgacccaccacgtaaatacagacgggttgacacgacaaggccaagtcgataacatggccgccacaaagggaagcgatagcttcctggcggtagaggatcaaagcttcacctgcggaacatggacaggtgcggtggcgaaccgaagctgcaactggttaggcagggtcccagggaatacctgtcgggtgctgaagactcacccaaaagagtctgagcgggaagcctccccgtccacggttaagcaaaggcacgttagtgccggtgggaacgaatagagtgtcagtgggatcgagaactagaaacctcggttaatcgcgactgacagtatgctgggtagtatcggcgggccgattgaacaaggccaggcagatagcgcaaagggtacgggggatgagtgaagacgatcccgaagagtatgcgcaggacaagccagaaccgctgatactacagggactatgccaatgccaaggtttgtcccttgaggcccttccaccgaggggattcaagagacagacctagttgaggaatgccgatggcacacttcaaggctaaggctcccaagtcgcccttcgctacccaggtagcgtactggcgggattgggaagccaaacgtactaagctcatcgcacaggataacgtcgaggggcgcaaagagcttcgcaagatgcgtgacgtgcgctacgctaccgacccggagccagcgccaggacgctaccacaaccctgaacagaaggcgttcgtgaagggtagcgaaggcaaggcgcggaacatcctgaagggatggaacgctaagaagtcgcaagggaagggtttgtaatgccacgtgtgaatgaactgacgccgcgtcaacgcaaagccgccaaggctcgccgcgacaaggcacgccggattgatctagcgcacaagatgccgaaaggcgccgactgcccgatcttccgcaaggctgaacaggcgcaagctaagcagccccgcgtcgataccctgaccactccccgcagtgccggctacctggccgccgctgcatacctgaacaaatccatctgaggtacataccatgaccaacgcaatctccaaaaccgtaatcgcattccgtggcaccgaagagatcaaccgcgctatcgacgccatccgtgtccgtggcaaggaactcgacgaagccatccaactgaccggcctgtcgatcatccatcacatcgaccagtgcggtgacgtgaccgtggtcaaggcgctgtatgaagccatgccgaagggcagccgccgcaatgcgctggtcgagtggctggtgctgcacggcaaggtacaggtgaataccgacaagaagtcgaacaaggacctgcccttcctgtacaacaagtttggcaagaccgatctcgtcggcgccaccaacagcccgtggtacagcttcaaacctgagaaagcgctggaccaggagtttaacctggccgctgccctggccacgatcaaaaagcaggtgcttcaggctcagaccaagggcaaggtgatcgtcggcatggaactcctgggtgatctggaagcgctggccgccaaggctgcacccatcgccgagcagagcaagcgcgctgccgcccattgactcaagtcgaacgcctgctaagcgggcgttccgctggaatcaatgacaactggagaaacacgatgagctttaagcaacgtctgcaacgtcaaatcgccctggcccaatacagccgcccggctcagttcccgtacggcgagcaagccgtccaggcgaagggggagtgaccatggatttctggatcgccatcccgttcctcgaactcggcctcaacctcggcgaggatgaactgcgcatgctgtggttcagcggcctgacggtattcttcatccacctcctcaagcggtgactcaagtcatggccctggcgggcgaccctcgcctactccggggccatcgctggactcatcacaagcgagaactagaccatgcaagctttgaacactctgttgatcgcaatccccaaggacccgtcgaacgcattcaatgcagccgacaaggctctgtgcgcccacggcttccgtatgggtgacctgaacaccgcgcacgtcctgacccccggcgggttcgtggtagtgggcgctggcgtgactgtgaaccgctacgacgaagcgtaccgtatgagtcggaacctcgactccgaaggcttcgacgtgctgctggttcagggcagcccgctggcgggtcgcgtcacctgccaggcgtacggctggatcaacgctgaataccgcaagggctgcgcgaacgggcgcccgatcttcgacattgcaggaacctcgtaccatgtcctcgcgtgatccctaccacatcggccaccgcgttgggctggtgaactacagcgaccgctacctcggtgccgacgcggcaggcaccaagggcatcattgaagccataacccgaccgtcccgctgtatgacgatctatcacgtacgctgcgagcggactctgcgcctgatcgaggccgaggcccgtaacgtgcgattcatcagacagctaccgatccgcaaatgacgtggcgcataatcgtcgtcagcccatcaagcggctgcgccttcgtgtggagtctcaagcggcctgtgcggcccgtgcgattctactcccgtaaggcagctaaatgctggctccgcaagcaccgccgacagggcttgcctggccactactacctcatcgtgaactggagcaaacgcctatgaatcctacttacgtcgtccgcctcaaggacggaaccacccgccaggtagtcgccgacagcatcgtcaccggccacgccttcgtcgaactctggttcctcggaggcgcggtcgctatctacccgacctgcgaagtacaggaggtccaccgcactgacctcgtaaaggaggggtggtgttgaatacccgcactgtatacgtcaagccgcacagttcgaggtgcccgccggtattgtccgcaggacgcctgaccccgggtgaactctaccacgtgatcgcacctgccgaggtcgaaggcgtcattgtgctggcaacttcaggcccgtggcacatccggtccgtggtggtgcatagcatgcacccctcggtatatcccgtagggatggctgtcactgacgattcctggcggttccgccgcctgggcgtgagcgagtacgtccaactaattcaagggtacgaacaatgatcgccgcactgatcctgatcgcgatcgcctacatccttgtaggcgcccttgtgttgaccctctactgcttggtagtgtcgccgcccttcgagaaccctacagaagagcaattcgaggacgcttgcctggccggctgcatctggccctcttgatcgtagtcatgatctaccaggcggtgcgtggcttcctacagggcgtacgtggcgggttgtaccgtcacctgttcaacaaatcgacgaggaattgagatgatccgcacccatacccacaagtcccaccgcgaacaaggtcgtctctacgatctcacagacctgaactccggtgagatgtaccaggtagtacagcctgagtccaagcgaggcacgctggtggtcggcgtggcggcttggaacagccagggccgccccgtagtgctccccgtggtcatccacgacagtggcgacgccaaggtgactggtccacggcccaccgtgctgcgcaacgacggctggcgcatggtgctcgccgacaagggcacccaggtaacactcaccgccgagtgaccaaggcgaaggctggcgcaccagccttccaccgtggccattccttgccgcgaaccaactcaaccgaggagctacaacatgaccaacgtcaacaccaccaccgccaccgagaccaccaccgctgctgtcctgggtgccaagctgatcaagaagccggccaccgtcgaggacttccgcaacaacgtggtcttccatcacaacgccttggccaagctgaccgaggtctacaacgaatcggtcctcgccctgcataccgccgagcgtctgtccagcctcgttgccggcgacgtaatcaccttcgaccacggcaagggcgagaaagccgaggtgctgagcggcgaagtcatcagcgtggtcgccggcgtctaccaggtactggtccgcttcagcgacaacgcgccggccaagctgctggacgtgaaagccagcgccatccgcgctgtccaggcaccggcaaactcggctgaatgcctcgacgaggccctggcccaaggcgagtaaggcccgcacgtaataggcccggccctccgggcctattgcgagctagccataccataggaggagtcaccatgagcaagcgtaaccccgagcacatcagcggcgctgtgcgtagcgtcagcgtccagaagtcggcagccgtccaggaactggaggatcgactggagtctgccctggccgtgtgccagcagcgggcggaagacatcgatctgctgagccgccgtctccaggccgcagagcgcgcccgccgctgggagatcgacgagattcgcaaccaccaggcgaccatccgcctgttgcagaacgacctgaacgctgcgcatgatgcccacgaggcacaagagcgccgcgctcgtaaggcaaccttcatggcctgggtatgcctgctgaccgcaggattggccgtcaccctgaaactggcaggagtctaaccatgcagtgcaacgatcactacactaagcttgcagcgagcatgttcaacgtaccgtgctcccaggtgaccgccgagatgcgccgcgtagccaagagccgggccttcgcggaggcgtacacgcccaagaagcaggcgtcgggtgggacgtataccgcccgcgtgagcggcgtcacctgcgagggcggtaaggtcgaggtgcggctggataacgtggagcgggtcacctcctgtaactatgccaagctggaggcgctggaagcggccagcctgtaccaggccgccgcgaagcgtgccgatgagtacgaaaagctcctcctccaggtattccccgatatggcgcggaaggacggcccgctggtcgccaaggacttcgcagcgcgattgaacatgctgcgcgtgaccagtctatcggtaaggcgtgccctacgggatgccgggatagaggcagacggcccgctgtaccatcgcgtacggaagctggctgaccggaataacgtgatgagcgccgagctgttcagcctcaagcagggcttggcacaactggtcgaagtgggacaaaaggccggactgtactgggatggcgcggagactcagcgcttactgacggtagccccaaccaaggccctctgtcatctcaccagcaagttgaccggcgtgcggtatacctaccgatctgtcgtgagcaaggccgaagcggcggctcgcacactggcactggcccaagccaaggataccctgcgtgtggccaccttcgcagccaccatcgccggcggcatcgtgggtagcgtgctgacgtacctgctcgtctaagcgaccagggcctactccggggtcaaatccgagggcgttcctagagcgccctctcgtgtgagtctggaggatcacgaacatgcaataccacttcacgcattacaacggataccgcttcggcgtcgagctggaggacgaagccgtcttcccgtgcatcgacggcaagcgggcaacctgggacaaggtggcggcgtgtgccggtagccttgtgcattacatggcgcaggacctgattgacttcggccagcgcaaattgagggatttggaagatgagcaagacgagtctgtacccgctgagccttcatcccggcctgatctcaatcaggacgatacacgtattcagcatccaagctccgacgagcgccgcgaactggtggcagtggttcctctggcagcggaagtaccacccgctccgggagagcctcagcccagccggggaactgagtgcgaatatcgccgagtgtgtgctccacctccgccggaatggctggcacgatagcgacatctggcgcaagaagggcggcgtgctcgccctcggtgccttcagcctcgccggtgagatggtcggttcctgcctcgtagtgggtggtgagctgaaggcactgtgcgtggacgaccggtacagtggccagggtatcggcgctgaactggtccgggccgctgagctggccggtgccgagcatctgacctgcttcgagttcctggagccgttctacgccggcctaggctggagcaccgtccgccgggaggcgaactggaccgaaggtgagccggacgtgctgcacatgagggcacccggccatgacgcatgaggtgatgacatggcttatcgcgaacaaaccgctggtcatcggagccgccttcagtctggtggccctgggcgtgctgctcacacagaacaacggcggcccgcctacggcacccgcatgacctggcatcttcaggacatgttcgaggcccgtggtgggcttcggcccttgtgggaggagtggtatcaatggcactgcgccgagactcctggctaaagcaagcgcaatccctggcagtcggccagacggggcgattccgccacgtcctgggatgcaagagcatgagccggggcgggaccaatatgacctgcaagaacctgcctgaccgctgggtagcatactgctactcctgtcaggagggtggcgtggtcgagaaaacgcatgtgcggagggtacaatgcgcggatcaagaacggttcatgccctggcccgaggatgcctcggactggacgcaggccgactgctatcaatcgctctatggtttgctgctgtccaagggcatcgactacaacgtgatgacgccagggctgccgctgctgtacagcgaaaggcagcatcggcttatcttccctaccgacgcgggctggattgggcgcgctactgccgaccaaaatcccaagtgggtgggctacgggtatcctgccccggactaccatggatggccccaggaattatcaacgggcagaccatgggtgctgacggaagactacttgtcggcgctgaaggtgcggtgggcctgtcccgaagtctttgctgtcggtctgaacggtacaaggctgcgcgacaggctggcggcagtcatgttgcagcagacctgcaagcgcgccttcatcttcttggatggcgacccggcaggtgtccgtggtagtgcaggcgtgatgcgccggctccggtccctgcttatcgaaggccaagtcataccaacgccggacgggttcgatccgaaggacctgacccgcgagcagataaggagcctagtaattggacgtattgacgcttcacgcactgagtgaccgggaccgcttccgcacgttgcggagtgtggtccctgaagggatgatggggccggagacgtgcttcgtcatcgactggatcgagcagtattggaaggtctacccggttcatcagaaggtagacccgcaggcactgcgcgaactcatcaagctgcgaggtggctaccagccggaacaactggcggtggtcctgaacctcgtcaaccaactggacaagccggtggacccggactcgctacaaggcgtcgtatcccagctcaacgaactggacttctccgggcgggtggatgccctcctggcgcagtacaaccagggcgaggacatcgacctggcgtatgagctgcgacgcctgagcgacgaggccctgcgccgcgagggggtcagcacgccaaccgactacgtgacggacgacgtgtttgatatcctggcggaagagcagggtgaccacggcatcaagctgccaggactggtgctgccggcgtatatgaagggtctccacgctggggcctcggtgctggtggcggcgccgccggatgcgggcaagacctcgttcatggcctggatcgctgtacacatcgcgccgcagctcaagcggtacttcgaccctggccggcccatcctgtggctgaacaacgagggcaagggacgacggatcaagccgcgtctgtactcggcggccctgggcatgaccgtgggtgagattctcgccctggacccggaagaggttcgccggatgtacgctgagaagatcggcggtgactccgagctgatccgcatcaaggacttccacggcgggtcgctggctcaggccgagcaggtcatcgacgcaatgaagccggcggtggtgttttgggacatgatggctcacgtcaagggtggccagcgcaaggaccagaaccgcaccgatgagatggagtacaaggtggccgaggtccgcgagatggcggtgcgccacgatttcatcagcttcatgacgtggcagattagcaacgacggccacgaccagttgttcccgccgcagtcctgcctcaaggattcgaagacggcggtacagggcgctgtggacgtgcaaatccacctgggccgtctcaacggtgcggatcaacaggtcatgcgtggcctgtccctgccgaagaacaagttccagatggacgggaagccttcgaacgtggaggccatgattaacttcgacgccgcacggtgtcgtttctttgagagtgtagaccatgcaagttaagcactacgatctgttgaaaggcaccaaggagattccatgcgtcgagctgtccagccagatggagcagctcctcctgcgcctgtactccgacgttacccacttcgaaggtgtggccctggccggcggctgcctgcgggacctgatgcacggcgccgagccgaaggacttggacgtggccctgtacagcatgtcccagcgccgcgctgaacaactggtggccgacatgctgggcttcctggacccgctcatcctgcgcggtggtggctggtcttctcagtacgccgactgcggcgagagcggcatcttcgtgggcgtcatgcaactcatcggctgccgtgggctgggcgggtgcgacgtggacttcaactactacaacgccgacagcctaggccgcgtcctggaatccttcgacttcaccatcaaccaggttgccgccacctaccagtggccgaacccggaagacggtccgaagctgggcacctacctgcacaaggacgttacctggggcgtgaacaaggaggtcggagtaggctccaggcgtcccgaacgtcgtgagaagatgctggccaaggccgcgtattacggatgggagaacgtgtgatgagcaagcgcgacgtggtactggatatcgagaaaggcatctggcgcggtgttgaccagaacgacaaggccgtcgaggccataatcaagaagcacgggtacgtgatcgtcgagcctaagatcgacgggtgccgtgccatcgtgggtgcgcatggcgtggtatcccgcagcggccgccgcttccctgccctggacggcctggaggatcgcatcatcgcgaaactgtcccagtccggcctggactccggtctggtgctggactgtgagatgtacctggaaggcatgcccttcagtgaggcgaccgggcgtatggcccgcaaggccccgctgacagaggccgagctgaagtgcctgcacttcgcggtattcgacgccacccatatcggcgtgctccgcaagtcgcgcaagtcccacctcgtgtacgatgagcgccgcgccatggtccgcagcctcatggaagattgccggcggggcgacaccccgtacttcttccaggtagccgcacaatcctgccgttctatggaggcggtactacgctggtcttcgaggggtcgatggagaaagacccgagcctgacctaccgcaacggcaaggttgctggctgctacaaacgcaagccggagatcaccgtggacgggcgtatcgtcgggtacgtgatgggcaagactggcaagaacgtgggccgcgtcgtgggctaccgtgtggagctggaagatggttccggcaccgtgggcgccaccggcctgagtgaggagcacatccagctcctgacctgcgcccacctcaacggctgcatcgacgaggccatgccgaactatgggcgcatcgccgaggtctccgcgatggagcgctcggccaacaccctccgccatcccagcttcagtcgcttccgcgacctggccagtaaccctggagtgaaggtatgaagattcgaaagtcccataaccgcaactacccggaagatatggtgtaccacgccaccaaccgggattcactgctgtatccgaagtacgtcatgggttccgtgttcatcagccaggacggaacattccgtatctgcgtcatggcagggacttgggaccacgttgggtccgaagttcggcatcatgcgcgggacatccaatccctcggcgccggtcgccgtaagttgcaccgggtcatgcgacggctgcgtcgcaatctgcaacaggtaggagtcaaggtatgagaatgccaaccgaagaagaacgcacgatccgctgcctcctggcagacatccatgaacccttgaacctgctgttccccggtatccgtgtgaaggccgagacactgcccttgggctggggcgatgatatctgcgccctggtactccgggtgagctacgagcatctcacgctgggtcgcctggagtacatgcacgaggtccccatcctgcacctgacgcagtggggccgggacggcatgctccagcacctgatgaacgagattccccgtcgggtactggacggcatgctgcgccaggcgcagaagtacagtcagagcaactggtacagcaaatgacgactatccgaatcctcgacctcgaaaccgagagctacgagcacaaagggcgcaaggcgtcgccctttgacccccgcaactacatcgtcatggccggctggcgtgacgacgttgacggcaaggtcggccagaaggtggagcatcgcttccgcagtcgggccgaagccgaggacccgaacaaccgctggttcaacctcgacggcgtggacgtgatcgtagctcacaacgccatgttcgaatcgaactggttcttcacccgctaccgggacgagtacctggccttcctgcgacgcggtggccgggtctggtgtacccagcaggccgagtatctgctgagccatcagacgtggctgtacccggcgctcgacgagctggctccgaagtacggcggcacccacaaggtggacggcatcaagatgctgtgggaccaaggcgtgctcacctcggagatggaccaagacctgctgagcgagtacctgtccggcccctgcggcgatatcgagaacaccgccctcgtgttctatggccagttgatgaagctccaggcccgtggcatgtgggctggctacctggagcgttgcgaggccctgatcggtttctccgcgatggagtgcgccggcctgaaggtggacctcgaagtcgccaaggtgaaccacgccaagcaactggaggaggtggccggaatcgaggctgagctgaagaagctgatgcccgacttcccggaatacttcgagttcaagtataccagcctctaccatatgagcgcatggctctacggcggcgaggtgcggtacaagggccgggtgctgtacgaagatggccggatggagaaggccgacttcgtacgcttcgggacggccaagcgggggactcccatcgagagtacctcggtgcgggtcccactccacgaagtgaccgaggacggcggccactggaactggcacgccatcaccgagctggccagaaaatacggcccggtcatcaccttctccgccggcaagaacaagggcagcatcaaggtattccgcgaggacacagacattccggcgaccaagtgggatgacgaccagcgcttcaagttccccggcctaatcaacctgaacaacctgccggaagtggtgcgcgagaagttcctgggcaagcgcccggagttccagtgcgccctcaccctagcggacggatcgcccgtgttcagcaccagcggtgacgccctcacggctctggagaaacagggcttcgaggcggccaagctgctgattcgcctggccgagctacacaaggataactcctcgttctacatcacccacacctacaacaaggatgggacgattaaggacacgaaggggatgcttcagtacgtggacgatgacggcatcatccaccactcgctgaacacgaccgcgacggccacgactcgactgtcgtccagccgcccgaacctccagcagctcccgtcgaaggacgaggatgacccggaggccggcagccgcgtgaaggagatgttcgtgtcccgcttcggcgcggacgggatgatcggcgagaccgactataccgccctggaggtggtgatgttggcggctctgtcgaaggaccggaacctcctggcgaagctgatggccggcacggacatgcacttgtaccgcctggccgggaagcacaacaactggaacggcttcgattacgaccagctcgtggccatcaagaaggaccccagccacccatggcacggtcgcatgatgcaggcccgaaagaacatcaagcccaaggcgttctcggcgcagtacggcgcgagtgcggcaggtatcgcattcaacaccggctgtaccgtggaagaggcgcaggagttcttggacaacgaggcggccctgttccccgagtccatcgcattccggcagatcgtccgcgacagtgcagaggccaccagcctcgtgatgtacaaggccgaggaccagatgccggcaggcgccttcagcgagatggggccggatggcaactggcggcagtaccgccgagggttctggcaagcgccgggaggcacctgctacagcttccgccaacaggagcgctgggacaaggaacagcgcaagacggtcatggacttcaaggacacgcagatcgccaactactggaaccagggcgaggctgggttcatgatgaccgtgagcgtagggcgcatcttccgttggatgctgcatcgcccaggattcatggttaccgagttcctgatcaacaacgtacacgatgccgtgtacactgactgccacaaggacaccgccgccgaggtcaacaagggcgtgcgcgacatcatggccgacgctgcccgctacatgagcgagcgattgggctacgacatcgcggacgtccccttcccggcggtggccgagatgggacccaacatgttcaacatggacgtgatccgggactaggccgaccctagcctactccggccttaaatcttcattcgacacgagagagaccacgcatgactcaacaactcaacgctctgcaagccgccctcgccctggccaacaaggctgccgagaccgcaaccatcgacatgtccgaaacctccaccggcggtggcggcggtcgcatcttcccggcgggcaccgccatgggccgcttctgcatctacatcgagctgggtgaccacgccaaggaattccagggcaagctcaagaatccggcgcctcaaatccgcctgggcttcgcattgtggggcgacgtgaacccgcaggccggtaacccgcagagccgcccggacgacctgttccacacctacgaggccgacggctcgatcaagcccggcctgttccgtaccttcgagatgaccctcggcaacaacgaaaagtccaagaccaagctggccttcgacaagatgaactggagcgggcagcatacccacttcgctcagatgctcggccaggcgttcatcatcccgatcaagcgcaccaagatcaccaagggcaacaacgctggtaaggaacgcaacgacatcgattggggcggcatcatgaagccctataacccggtcgatggcagcccgtataacgtgccggaactgccgatggacctgttgcagtatttcttcttcgacgcgccgaccaaggagacctgggacgccctgttcatcgaaggcacctcggacaacggcaagtccaagaacttcctgcaagagaccattcgctcggccaccaacttccccggctcggccctgcacatcatgttgggcggcggcgacgatctgatcatcaagccgacgacccaggccgcaggcagcaacctgccggcagtgcccaacgtggccgccgacgccggcgtagcggcagcaccggctgtcccggctgttccccaggcagtggctcagacggcccccagcgtgccccaggtggcgaatgtggccgcccctgtggtaggtactgccgaggcacagaacgtgctgcctgacgtgccccaggtggctcagacggcggctccggcagcggtcgaagtcccggcggtcccggtagtgccggcagtaccgcaggtctaatgcgcctgccatcggaagagttcctggcaggactatccgcgcagttcgaccgcagcatggcaggcgggacgttggtgtgtgacgccgacggacccgcctacgtggctgcggccactgctaagaccctggacactgcactccgaagattctggaagctcattttggagcagcagttcctagcgcactgcacagggacacgggttcacctcacggcagcaggtggggcgaaggcgtaccgcgacacgtatccgaccatgaaaccgtaccagggccagcgcaagggcaaggcaaagcccgcgctgctggagccactgcggcgggccgtggcggacgtgcatgagcgaggcggggcgccggaggggatcgatgtcatcctgcacacattcttcgaggcggacgacggcatgatgatggacgcctacgccatgcaggacaaggccatcatccggtccgacgacaaagacctgcggatgacgatctacccgtattgggagatcgatacggcatgtgtgagcaggatcgagggtggcttcggctacctcaaggaagcgtacacgccttccggccagttcaagctcaagggccatggacggaagttcttcttggcgcagtggctcggcggcgacaccgctgacaacatccgagggatcgatcgattcaacggtaagctctgcggtatgaagacggccttcgacatcctccatccgatcacggatgaggacgaggccatcgacatgatcctggaggcgtacgccaagatcaagcaaaacccgctggcagaggccgaggtgctgtggatgcgccgaacgcctaccgacaacgcagcgcagtatctgttaagccgcgaccttcgtccggccttccgccagtggatcatcgagctggacgcctaccacgaggcgctgctccagaagcggagggagagcgattatgacgagtgagccgaaggtctaccagataccgcgcagtcaacagcgcaccttcaccctgaagctatgggccgggcagaacaagctgtgcccgctctgcggcaagcccatcgatatcagcgtgaagggcgaagcggtgatggaccacgaccacgaaacggggctggtgcggggcgtcctgcaccggtcctgtaacaccgcagaaggcaagataacgaatgcggcaggttcctggggatgcaagtcgatgaagtattccgacattatcccctaccttcgtgccctcctgacgtatctggaggggccgaagcatccgctgatctaccccctgcacaagaccgacgaggagaaacacgaagcgaagctggccaagcgccggcaggcagccgccaaacgcaaggcggcgatggccgtcgcaaagcacaacgcgaggaacgtatgagcaaactccgcaagcaattcaccaatgagtacctgcgaaacgtctatgtcgagctgggtctcaagaagggcgccgagcatctgaccaggcattcgcgcttcggcgaagtgagccgccagtgcttccgcaactggtgcatcaagctgggcttccacgacagcaggacacgcggcacgtacgccaagaagggcgctctgcactggctgggccgaaaggccgccgaggtagtgcgcaagttccctggcgccgtgggcaacgtggtcggccagggtccgaaggtactgagcctggacatcgagacctcgcctatcgagggttgggtctggtcgctctggaagcagaacgttggcctcaaccagatcaagcgggactggaccatcctgtcgttctgcgcgaagtggatgcacagcgacgaggtgatctacatggactgccagggtgatcccttggacgatatgcacctgctggtcgccctgcataagctgctggacgaagccgacatcatcatcgtccagaacggcaagcgcttcgacgtgcctaagatcaacgcccggttcttcctgaacaagatgccgccgccacgaccgttcaaggtgatcgataccttgatcatcgccaagcagcaattcgcgttcaccagccgcaagctggagtacatgacccacaaggcatgcaccatcaagaagcgcctccacggcaagttccccggattcgacctgtgggcagcctgcctccaggacaacccggaagcctgggaggagatgcgcctgtacaacatcgacgacgtacgatcgatggaggagctgtacatcctgatgcgcccgtggttcgtcggccatcccaacgtggccgtgtacttcaatgacgccgagccgaccatccgatgcccgaagtgtggcgacacggatgtcaagcaagaaggctgggtgcatacgcagaccggcaagtacgagcactatcactgcggcggctgcggtggctggagccgagggcggtacacccgcaacacctcggaacagcgcaaggccctgctgagcaactaaggaggtagcatgagcctagcattcccggactcttacgggccgacgatcacgactgaaacgtaccgcaaaggtgcgagtctggaagaacgcaaggttggcaagcttcccatgcacctggtagtcgaggggttcccgctgctgaagcgggagcttgctcgaatgatgcaatgggctgccgaggtcaaggggtatctgccgcacgactggaagaagatgacggtgggtgagttcaagtccgcccaacacaggcacgagtccaagcggctgatcgacgggccgctggatgacgagtccaacctgatgcacctggtgcatgaggcattcaacgcaatggccgccgccgagcgtgccctgatggaccgggagaaaggcaatgagtaaaatctgttggtgtacccgaccgcacgagaccgatgaaggtgtccgtgtcatctgggccttcaacgagcggggcatcggggtaaactacgtcacggcgtacatcacgccggcgatgatccaccacccggactggagcgatgccatcctcccggacatcctccaggagatggcggagcgcctggaccgagaggttaagctggtggaattgcgctggttccgcgctgagattctgagctgcggggaatggcgcgactaccgagcaatgacgctggacggggcggttagcctggccgaggccgagtggggtcccgaggatatcgggcgtgtaatcgaaagacgataggagacggaatggacctgatacagcagcagatcgcccacgaagaggcccttgtcggggcggcgcagaacgacgcccgcattgccttggaaaaggcgattgcccaagggtccatcgaccgcatcccgagggcacgcatcatgctgatgcggatgctccccatcgtgaccgaagcgatcttcgcccaccaggaagcgaaggcggcggggccggcagcaaagctgcggcacctgctgaggatcatcgacgcccaggacctcgcagtcatggcgctgcgggccgggctgtcgatgctcatcaactacccaacgatcaccgcgacgaagtattacacccatatgggcaagatgctctgtcgcgagatcgaagtgcggttggccttcaaggtcaaccaaccctattacgaccggacgctggactacctcaagaccagcaggactcgcagcgtccggcacatccagaagacgatggacgctcttctggacgcggtactgccggaagaggcacgtatcgacctgccggatggcgactacctgcgcctcggcaagttcatcggcgacccgctgatccaatgcggcctgttcgagccgaaccgcttcacagggcggggcggtacgagcgtccacctggagccgtcgccggaggccaaggagttcctgcaagacccttcggcggcgatgacctggggaggcccaggccgtagcgtgatgctggcgccgcctcgaccctggaacgactggtgcgatggcgggtactacagcaccaaggcacagaagcaccatgtgttggtacggcgcaccaagcaccagaccaagcgggcacgccagatgcagctccgccacctgggccgggacaagatgcccaaggtgtacgaggcggtcaacgcgctgcaatcggtggcctacgagatcaaccacgacgtgtacgagatcatcgagcgcgtcttcacttccggcggcggcgtgcttggcatcccgcagcgcacctacccggagaaacctgagttcccgctcggcgacgagtgggccaaggagaacgccagtgaacaagagctggaagccttcaaccgatggaagcgatccgtccaccgatggtacaccggagagcgggagcataccgccaagcttcgcgagtttgctgcactctaccgagttgttcgagagcatcatggcaaggcagtgtacttcccgatgcacgttgactcccgtggccgcatgtactattggggcacaccgaatccccaagggtccgacatcgccaaggcatgccttcagttccacgaaaagcgcgccctcggcaagcgcggcctgtactggctcaaggtccacgtcgccaactccctcggatgtgacaaggtgtacttcgacgaccgggcagcctgggtcgatgagcgatgggacgacttccagcgggcactcgacgaaggcccggagaactatccgagtctcttcccggaagacgagtcgcccctgtgcgccatcgcaggtctgctggagctgcgggcggcctacgcatcaggccagccggaggcttaccgaagtgggttcatcgtccacatggatgcaacctgctccggcctccagcactactcagccattctccgagacgagatcggcggagcctacgtcaacctgttgccacctggacttgccaaagctgacatctactcccgagttctcggtctcgttgcagagtctctggcacgagacagagaaagtgctgaaggcgaggctcggggctacgctgtactgtgggataaggctggtctatcccgaagcctgacgaagaagccctgcatgacgctggtatacggcaccacgttcaagggcgtggtagaccactgcctggactacctggacgagtccggcctggagattcccgagggtatcccgtcataccgcctgggaagctacatggcaacgctcatactggacgcaatccgcgagacagtaccatcggcagtcttcgccatggaatggctccagcggctcgctaaggcccttccggacgcatccaaggatttgcactggatcacgccactcggcatgcaggtcttccagtcgtacccgaagaccgaggaggtgcgggttaggctgcgggcagaggctgtcgagtacgtcaccctgtacgaggccaaagatgagctggacccggtacgcaacgccaacggcatcgctccgaacttcgttcacgggctggacagcagccacctgggcctgacggccctggcctgtgcggcagagggtatcccgatacaggccatccacgacagcatgggcacctatgcggcagacgtggatcggatgcacgtccacatccgggagcagttcatcgccatgtacagtggcccctgtgtgctcgtagagctggcaaaacagcttgggatagaggctaccccgcccaagagaggatcgttgaatctggaggctgtacgggactcctgggcgttcttctgctgaggtggattatgtcacccacataggagcaagtgcatccgtccaaggccctcgtagagggagcagggagagagaggggtcagggaagaccagagggtagaagaagagtagagggagagtagaagatgagactagatgactacgaaggattctagatagagtagactaaccaacgtaggagatatgatagatggctactatgaagacccaccgccctatggttatgtcacccacagtggaaggatcgagaacaggcaagggtacggcccgccctgtcacgttcacctctcagcagatcgagtggttagaacagaccttccccgaacatcagatcggccctggaaccactatggaagacatccagttccaggccggtaggcgagacgtggtgcgagcagtgcgcctgcgccgacgcgatgccatcgcagtggagctgaagtgatgaacaagtccatctggcgagtccacgcaaaggccggcactccctcggaactccagggcctgtgctggctggcaatacaggagttggaggagttcaccctcttccgctcgaaagacgacgccctgaatacgatgctggacagtatcgagggcaatgatcgaaccgagctgttggtattccgcgatggccagttggccggcggtgcctgcattgtgttcgaggacgatccccacgtcggcccgtgcgtcacagcacagtggcagtacgtcctaccgcgctaccgcaatacaggcgtggtccgggagttcatccgcgaactccaccgtcaggccggctggggtcaaatccccctcgtgtgctggagccatcgtgaaagcgatagccggtacacgatccactaccggagagccaagccttatgggcaagaaagtcaagaaggtgctaggcaagaccatcatcggcaaactcgctgatggcctgctgggcaccgatctgagcggcgcacaatctgatgcccgcaagatggaagagcagaaccgcctcatgcagcagcaggcggaccagctcgcacgaaaccagcaggttgacctcaccgccgagaacgtggcgcaggttgacctaggagcgatggccgatgccactggcaccggcacgcgacggcgccggaatcaggcgggcacaggcgtatcgcaaaccctcggtatcaactactgacgaggtacgccatgaaaaccaccgcagctatgctgtgggagaaacttcgggatgggagcgtggagagtcgagccatcgagttcgccaagaccacgctgccctacctgatggtcgatcccatgtccggcagccggggagtcgtagagcatgacttccagtccgccggtgccctcctggtgaacaacctcgccgccaagctggccaggtctctgttccccacgggcatcccgttcttccgatccgaactcaccgacgcgattcgccgcgaggccgacagccgggacactgacatcaccgaagtgaccgctgccctggctcgggtggatcgcaaagcaacacagcgcctgttccagaatgcctccctggcagttctgacgcaggtgatcaagctgctgatcgtgactggcaacgccctgctttaccgcgacagcgccgctgccaccgtggttgcatggtcgctccgctcctatgcggtgcgccgcgatgcgactggccggtggatggatatcgtcctaaagcagcgctacaagtccaaggacctggacgaggagtacaagcaggacctgatgcgcgcaggtcgcaacctgtccggttcgggtagcgttgacctgtacacccacgtacagcgcaagaagggcacggcgatggaatacgccgagctgtaccacgagatcgacggcgtgcgtgtgggcaaggaaggccgatggcctatccacctgtgcccgtacatcgtgccgacctggaacctcgcccctggcgagcactacggtcgcggccacgtcgaggactacatcggtgacttcgccaagctgtccctgctgagtgagaaactcggcctgtacgagctggagtcgctggaggtcctgaacctcgtggacgaggccaagggtgcggtagtcgatgactaccaagacgccgagatgggcgactacgtgccaggtggtgcggaagccgtccgtgcgtacgagcgtggcgactacaacaagatggctgctatccagcagagcttgcaagccgtagtcgtccgactgaaccaggcgttcatgtacggtgccaaccagcgagacgccgagcgcgtcactgccgaggaagtccgcatcactgcggaggaggcggagaacacgctgggtggcacatactcgctcttggccgagaaccttcagtcgccgttggcgtacgtctgcctgtccgaggtggacgatgcgctcctccagggcttgatcaccaagcagcacaagccggctatcgagacgggccttcccgccctgtcccggtccgctgctgtgcagagcatgctcaacgcttcccaggtcattgctggcctggccccgattgctcagctcgatccacgcatctcgctaccgaagatgatggacacgatttgggcagccttcagcgtcgatacctcgcagttctacaagagcgaggcagagctacaggccgaggcagagcagcagcgccagcaggccgcacaggctcaggcagcccaggagaccttgctggaaggcgcttccgatatgaccaacgcactcgcaggagtctgatagatgtctcaacagaacgaacagcaactgccgccgggcctcgctaacctggttgccaacgtaccgccggctgccgcgccgaccccgagtcatgtgcaggtgatgccgaatccggtgatccagccgcaggccccggtccaacccggccaggtgggttcgccgcagcaactggccatcccgacccagcagccgcaacccgttccgaccagcgccatgacgccccactaccagccggtagcggtgcccgtcgccggtcaacccgttgttccgcaagcacccgctcagccggccccggtagctccgccggctgcgggtgcagttcttcccgagaacctggaagtcccgccgccgccggccttcactcccaacggggagatcgtaggcaccctggcagggaacctcgaaggcgacccgcagttggcgccctctatcagctatctggaagcattctctgacaagctggataccgtccgtgccttcggcaaggccgccgagaaccgcgatccgcgattcatcgacgagcactatctgaaggaaatcctgggtccggcccaggcacagcacgtcatcaacgtggccaagggcgtcctgacttacgtcgatgcgcagaccaaggccgtcctgaatcagacctatgccgccgtcggtggtgaggccgtcctgaagcaggctgccggcgtcttcaaccaacacgctgacccggccaccaaggccgccatcggtcggctgatggactcgggcgatgcccaggccatgcagtacgcagcgaagcagatcatcgctttcgcacaaggctccggcgccgttgtacaggctaccggccaacccctgggtgctgcggcacctgcactcgcagccctgaccgctgagcagtaccgcgcagaggtatcaaagctgccgctgaacgcatccgaagccgacatggctgcgctgcgcgagcgccgtaaggcaggtatggcgcagggtatctaacgaccctgccctactccggccttaaactcacatccaaaagagagagaatcgcatgagctttctgaacgacctgactcgtccgaactacgctggcaagaacgcggacgttgacatccacctggaagagcacctcggcatcgtcgacaagcacttcgcctacacctccaagttcgcaccgctgatgaacatccgcgacctgcgtggctcgaacgtggtccgcctggatcgcctgggcaacgtcgaggccaagggccgccgtgccggcgaagagctggagcgcagccgagtcgtgaacgacaagtggaacctgaccgttgacaccctgctgtacctccgccaccagttcgaccaccaggacgagtggacccaatccttcgacatgcgcaaggaagtcgccgagctggacggccaggaactggcccgtaagttcgaccaggcgtgcctgatccaggtgatcaaggctgccgcgatggacgccccggtggacctggaagacgcgttctcgccgggcgtgctggagaaactggacctgaccggcctgaccgccaagcaggctgccgacaagatcgtccgtatgcaccgccgcgtagtcgagaccttcatcgaccgcgacctgggcgatgcggtctactccgagggcctgaccccgatgtcgccgcgtgtgttcagcctgctgctggagcacgacaagctgatgaacgtcgagtaccaggcaaccggcgcgaccaacgactacgtgaagtcccgcgtggccatcctcaacggcgtcaaggtgctggagactccgcgcttcgccaccaaggcaatcgcagcccacccgctgggccgtcacttcaacgtgagcgccgaggagtccgagcgccagatcgccctgttcctcccgagcaagaccctgatcaccgcccaagtggcgccggtccaggccaagctgtgggaagacaacgagaaattctcgtgggtcctggataccttccagatgtacaacatcggtgcccgtcgtccggacaccgctggtgccatcgagctgaagggtatcggcgccttcgacatcaccgcgtgatgccacgaaaccccgcacttcggtgtggggtttcttcaaagcctaacgacccgcgcagattccctgcgtgggtttttgcgctttaggagaaaccctatgctactactcgacgcagtgaatgtcatcctgcgcaagatcggcgagctgccgatcccgagcatggatgaaacgtacccaactatggccattgccctcccggagctggaggaccagcgcatccagttgctgacgcaaggctggtggttcaacacctggtggaagcacaagctgacacctgacccacagggtcgcatcaacctacccaaggataccttggcattctacccggactccccggacctccagtgggacggccagggagtgcgagacgccaacaccggcgacgaccgcatcggtaagccggtcgagggtcggctggtactgtccagggagtgggaccgtatcccggagatcgcacagcgcgtcattgcgcaccaggccgcactcgcggtgtacacccacgagattggcccggacgagaccgcccagggcatcgcccaggaattgcaggcgtatcagaacgaactgtcccgcatgcacacccgatcccgtccgctgaacacccaggccaagcgtagcttcagccggtggcggcgcagcttgaggacctgagcaatgagctacaagcaatccgcgtatcccaatctgctgatgggtgtgagccagcaggtgccattcgagcgcctgcccggccagctcagtgagcagatcaacatggtatccgaccccgtgtcaggactgcgccgccgtagcggtatcgagctgatggctcacctgctgcataccgaccagccctggccgaggccgttcctctaccacacaaacctcggtggccgtagcattgcgatgctggtagctcagcaccgtggcgagctgtacctgttcgacgagcgggatggccgcctgctgatgggtcagcccctggtgcatgactacctcaaggccgacgattaccggcagctacgggccgccacggtggctgacgacctgttcatcgccaacctgagcgtgaagcccgaggctgaccgcaccgatgtcaagggcgtggaccccaacaaggccggctggctgtacatcaaggcggggcagtattcgaaggcattctccatgaccatcaagatcaaggacaacgccaccggcaccacctacagccacacggccacctacgtgacgccggacaacgccagcagtaaccccaaccttgccgaggcgccgttccagacgagcgtgggctacatcgcgtggcagctctacggcaaattcttcggtgcgccggaatacaccctgcccaactccacgaagaagtacccgaaggtggacccggacgccaacgcggcgaccatcgccggctacctcaaccaacgtggagtgcaggacgggtacatcgcattccgtggcgacgccgacatccacgtcgaagtgtccacggacatgggcaacaactacggcatcgcgtcaggcggtatgagcctcaacgccacggcggacctgccggccttgctgccgggcgcgggtactcctggcgtaggcgtacagttcatggacggcgcggtcatggccaccggctccaccaaggccccggtgtacttcgagtgggattccgctaaccgccgctgggcagagcgggccgcctacggcaccgattgggtcctgaagaagatgcccttagccttgcgctgggacgaggccaccgacacctacagcttgaacgagctggactacgaccggcgcggctccggcgacgaggacacgaaccccacgttcaacttcgtcacccgaggcatcaccggcatgacgaccttccagggtcgcctcgttctcctgtcgcaggagtacgtctgcatgtcggccagcaacaatccgcaccgctggttcaagaagtcggcagccgcgctgaacgacgacgaccctatcgagatcgccgcccagggcagcttgaccgagccgtacgagcatgcggtcaccttcaacaaggacttgatcgtcttcgccaagaagtaccaggccgtggtcccaggtggcggcatcgtgactccccgaacggcagtcatcagcatcaccacgcagtacgacctcgacaccagggcggcgcctgccgtgactggccgcagtgtgtacttcgccgccgaacgtgccctgggcttcatgggcctccacgagatggccccgtcgccgtccacggacagccactacgtcgccgaggacgttaccagccacatcccgagctacatgcctgggcctgctgagtacatccaggctgcggcctccagcggctacctggtgttcggcaccagcacggcggacgagatgatctgccaccagtacctctggcagggcaacgagaaagtccagaacgccttccaccgctggacgctgcggcatcagatcatcggcgcgtacttcaccggcgacaacctgatggtcctgatccagaagggccaggagatcgccctgggccggatgcacctgaacagcctgccagcccgtgagggtctgcaatatccgaagtacgactattggcgccgtatcgaggcgaccgtcgagggcgagttggaactgaccaagcagcattgggacctgatcaaggacgcccctgccgtgtaccagctccagcctgtagccggggcctacatggagcgctaccaactcggcgtgaagcgcgagacgaatacgaaggtgttcctcgacgtgcccgaggctgtagtcggttcggtgtacgtggtcggctgtgagttctggtccaaggtggagttcactccgccggtgctccgggaccacaatgggctgcccatgaccgcgacccgcgcagtgctccaccggtacagcgtgaacttcggatggactggcgagttcctgtggcgcatcagcgacacggcccggcctaaccagccgtggtatgacacgacgccgctgcggctgttcagtcggcaactcaacgccggcgagccgctggtggatagcgccgtagtgccgctgccggccagggtggacatggccacgtccaagttcgagttgagctgccatagtccgtacgacatgaacgtccgggctgtcgagtacaacttcaagtccaaccaaatctaccggagggtgtgatggctttctggctaccactattggccgctggcggcatgtcagcccttcagcagggaatggccaacaaggaagagcgcaagaagatcaaggctgagaacaaggctcgactgaaggcggacctcgacaacctgggcgccgctgcccgcgacatcgccaacctgggcgtcatggccgctagctaccgcaagcaggctgtggcctcgcaggtggaggccaagcgccaggggatgctcgccggcggcagtgccgaggctcaggccggcgcgttcggcgtcaagggtgcatccgtggatgcggtggccctggacatcgagcgcgaggtcggggaggccctgatccagattgacgacaacctggacaatcagatgtggaacctcgccgagcaggcgcactccatccaggctcaggcgaaggccggcctgctggggcagaagagtaccacggcggggcaacggtccccgctggtggccggcctgatgtcggcgggttccctgtacgcaagtcaatacttcaagttcggcgccacgcctaaaggaggcaactgatggcggaatcgcaacgtgcttcccaagagcttgggatcaacgtcggacagacgcaactccagccgggccagagtgcccggcgaggggtgcgcgactccgaagtcaactacagcgggccgagtgtaggctcacagattctcgacggcatcctgggtgccggtcagcagatcgctggcaagtggttcgagcacaacgtgcagcaagaggtgctgcgcggcgagcgtgcccgtatggcgggcgaggccgaggaggccgtcgatagcaacatcctggccaagcccttcgtgaagggcggctggcgcaagcaggactaccgtatcgctcaggccgacttcagcctcaagatgcagcagttcatcgccaacaagggccgggagatgactcccgaggagttccgcaagtacctgtcccaggaggctacacacgtcctggactcgaccgagggcatgaaccccaacgatgctctacaggcgctggcgcagcagcagaaggccgaggagcagctattcggtatgcaggccaaggcgtacatggactggtccatcgaccaggccgcccgaggcttccgcacccaaggtaacagcatcctggccaaggctgtgcaggctcaggccaccggcgacgaactgtcccgccagctcagcttggaagaggccggcctgttctacacgaacatcatgacctccgaggatatcccgctggaggtgcgtgacaaggtaggcatgcagttcctggcggccagcctggacatgaaccagcggggcatctacgagagcctgcgcgatgccggcttcctggacagcatgtccttcgacgaccggcgcgccctcaacggcctctatgagaagtcgaaggcgcagacccgtgccaaggagtcgatggctaccctacgggccgatgcggacttccagcagcgggtcgccaacggcgccatcacggatcttgccgaggtcgaggcgtactcgcggggcatggtcgaggaaggccgctggagcgacgcacaggccatctcgttcatgaccaaggccatgaccggcctgggcaacgcgcagcgcatgcaaggcatcatggcggccctggaggccggggacatcaacgctctgcacacgctgggtacgaacgtctccgaggccctggagcagtgggacaagatgcaggcggccaacggctcaagcctgaccgatcgactcgtgcagggcacgcagctcggcctgcgcctggggaccttccccaagacctacggcgagtccgtgggcagcgccgtgcggatgatccaggcggccaaagaaggcgaggcgaaccctgagctggtcaacacgctgaacagcatcttcgaacaggtggcagcggctcaggagatcaacccctccgccggcaacgtgatgctatccggcatcccggaggccgagcagggtgccgtggcctgggcactcaagcagatgaagatgggcatcgccccagctcaagcactgcgcgagttcagtgccaacgccgaagtcgtgaagcagatggacgagttcgagaaaggccagaacaccaaggcgttcaaggacaacctcggtaagcaggtcaacgacaagttcgtgaacaacatcttcggtcgggcctggaacatgctgaccggtgagagcgacctgagcaacaacgaggccgtcctcagcatgtaccgccgagcgaccatcgacgaggcgaactggctggccagcgaccgcaagcacgccgggctactcaccagcgacacgggccgcgaagccctgctggagatcgccgccgccaacgtgcgcaaccgcaccatccaggtgggcgagggccgcaacctgaaggaaggggacctgttcagccgccgcgacagcgcgccgctgatcctgcctcgcgggaccactgccgagcagctattcgggaccaacgataccgagaccatcgggaccgtcctggccgagcagcacaagcctcgcgtggagggcctcctgggctacaagtcggccgtcgccttcgaatacgaccgcaccagcggtagactcctcgccgtcgagtacgacgagaacggcgtggccctggaccgcacacgggtcgatccccaggcagtcggcaacgaggtgctcaagcgcaactcggacaagctgaatgcgatgcggggtgccgagtacggtgccaacgtcaaggtcagcggcacggacattcgcatgaacggtggtaacagcgccggcatgctgaagcaggacgtgttcaactggcgtaaggaactggctcagttcgaagcctaccgaggagaggcgtacaaggatgccgatggttatagcgtgggcctggggcattacctgggcagtggcaatgctggggcaggtactacagtcacgcctgagcaggccgcgcagtggttcgccgaggacaccgaccgcgcactcgaccagggtgtgaggttggccgacgagctgggcgttacgaacaatgcctctatcctgggcttggccggtatggccttccagatgggcgaggggcgtgcccggcagttccgtaacaccttccaggcgatcaaggatcgtaacaaggaagccttcgaggctggcgtacggaacagcaaatggtacacgcagacgcccaatcgggctgaggcattcatcaagcgcatggcgccccacttcgacactccgagccagatcggggtcgattggtacagcgccgcaacagcggagtaagacatggcacagcaattcaagggccgcatgacgcccaagtatcccctagaccaagcacagctcgacgaggcccaagtacagggccaactcgacgccgtgcctaccgtggggttcgacgccctgacgggtggcgagatcggagaacggaacgtggcagcgggccaacgagccaatgcgcgggaactggaacgcatcgtagcggaccaggaactgccggcccttgaccgtgcttccgcactctggaaccagtccaccctcgtcggacgctggggcgatgcgctccagctcgacgcggacctggcggcgaacagcaccggcgaggtggaccctaacttcgacgccgggacctacggggtccaggcgctccaggcggcgggtatccagccgactgacaactacctccagatcatggcccgtgccggcaatgccgaggacgcggcctacctcctgtcgaggattcaacggtatgagcaggacgagcaaatcgtgcgggacaacccgtactggaacttcgcggctggcatgcttgaccctgctgccctggcagttgatgcggttactttcggcgctggccgtgctctgcggctcgggcgtgctggcatggctgctgctggcggcgctgggcaagtcgggtatgttgctgggctggatgccgcaggggccgacgtggatgccggaacctacatcgtgtcgggtgctcttggcgctggcgtgggtgctctgctggggtctggtgcgggacgcattgccgcagaggccccgacgcagccgcatgtgcccgaagtatcggcgcctactgtcgggctgccagaagtagcgatgaccgccgaggaggccgcagcacgcggcttcaaggccggtgacgtggtagacctgctggacgagggcactgtgctgtcccgtgtcagctcccgtgtggagcaggccgagataccggctatcccacgacgcgacactgccttcggcgacgagctgcacagcctgtcgggccggaagctgtccgaggtcctggaccacctcaagacccacgcagaggtgcccaagccgctccagggcatcgccgccaaggtggccgataccatcaggaccctggagggcctggggcagcgcaccgcgttccgcgtggtgcagggcggcgacaccgccagctccgcattcctcaagccgggtacggcggggattcactccacccagggcctcgataccctggtgcaggtgcgtggcagcaccgcgcccggacgagtcggcaccaacccggtgaccgtgctccacgaggcggtccacgctgccaccgtaggcgtgatgaacgctgccctgcgcaaccccggtgcgatgagtccgaaggtggctcaggccatgcagaccctggagaacgtccggggtaacgtgctcaacgctctgaagcaggaccgcgccgccggtcggcaactgtccgagttcgaggagacgctgctggccggtaactccaacaccctggccaacgtcaaggaactggtggcctggggcctgacggatacccgcttccaacggaccttgaaccgcttgcgctacagcgacggtgggccgggcctgtggtcccgcttcgtggaaggcatccgcaccctgctgggcctgcggtctgatgccgacacggccttgagccgcgtcctggccgcctctgagacgattatggaggccatgccgggctacacgaaggcgcaggctaagtgggccaacaagggcgctccagtgaccgaggaggccagcctggagaccatcgtccggtccaccagggaccgtgcccgtgagggtgccggcttcgtgaaccggttcttcagcgaggcggacctcctggcccagcctggagagggcgcacggcgcctcctgagccgtcttatcgacgaccctgtacgtcgggatggattcagcacgaacgacaacgcagcgagctatctgcgccgttaccggaacgagttcgaaggttacgtgaagtcctacgacgagatgatggccaaagcgatggctgagcagggcgtgggcctgacggcacgggcactgaactcccgccgcgccatggcagtccgggaccagcttaacgagcaggtcacccgcgagctactgcgccgggaccgggagtggaccgcctacggcagcgtccgtgtagacccgaacctgccgccgaccatcaaggccctagccgaccgctcagacgagattcatggtctgatgggtcagcgtgccagggaagccggcgtccgtggcttcgaggacttcgcaccgcgaccgggatacttccaccgctcgtggaactggtcgaagatggcgcagatggacgaggccgcccctggcctggcccgccgcgccatcagcgaggccgtgttccgtggcatccctgggctggagcgcgccgacgccgataccatcgcacaggccattgtgcagcgggcgcgggatcgggccaccggcatccgatccgagttcatgggagcgatgggcgtggcggacacggcattcatccggcaagcgctggaggaggccaacgtgtcccaggccaagttcgacagcatcatggccaagatcgagcagaagcagtccgaccagggcaccgtcaagtacggcaagggccggctgtcgctggacatgaccgccgagatcaaccacaacggcaccgtgtatcgggtgcaggacctgatcgaccgagacctggaccggctgatggagaactacgccggcagtatgtcgggccgctcagcattggcccgcgcaggcatgccgggggactcggagatcgaagccttcatccgggagtaccagcgagaggcagcccacctgggcaccgataaggtgcaggagctgacggggcaactgcggggagtcttcggggacttcaccggcaacgtgccgagggagcatcagctcggcccggttgctcagcgggccagcggactgaccagcgccaccatgctgggattctcaggcgtgtatcagctcgccgagctggccacgatggcgcaccgccaaggcgtcttcaacgtcatgaaggccatgctgaactcccgcctgggagacttcgtgggcgccatgcgtcgcgacccggacctcgctgacgagatgcagaccgtcctcggcctgaacctcgccaacgatatccggatgaagccctggaagcggcagttcgacaccttcctggccagccaagacaccttcatagatcgcttcctccacgcaggtaagcaggctgtcccggtgctcaacggcatgaagttcatccacaactggcaatcccgcatgaacgccaacctcaccttgaacaaggtggcgcgggcggcgcagggggatgaggcggcccttcgagtgctccagcagtacgggaaggacgtggactggacgccagtattggcgcgggttcgcggttatgtcacatacagaggaaggaacgcccaatccatgaattggggcgcctggagccaagcagacgtgaacaccgtcatgaacaccgcactgcggatcatggacgactcactcctgtacggcagggtcggtcagaactcgggcttcgctcggtctccggtcggtcaaatcctgggtcagttccgcagctttgtggccttcgcacacaacaagctactccggggaacctacgagaactccggcgtgcttggcgtggcctcgctcctcgcattccagtatccgctcaccgcgctgatgatgggtgccaaggcagcgatcaacggcaagttcgacacctctgacgaaggcatccgcaagatggccatcgacggcatcggttacactgccggcctcggcttcaccgctgatatgtggggcgtgatcaccgggcactcccggatgtccgccccggtcttcggactggcggagcactccaacgaggtgttccgtggcgtcaaggacctagtaaccggcgacgaccccgcagcagccactggcgatatcgtcaacggcgccgcaggggcactgcctttcgtcaacgtattcccggcgaccaagttgctgctggaatccatcaaaggggaataacgtggctcggttcaagaatcccgagaccatccacgttgcagatggggtcgaggctgtcttcagtctcgacttcccgttcctgcggcgtgaggacgtattcgtccaggtcgataagatactcgtcaccgactatacgtgggtggacgacaccaacatccaattggccgtggtgccgaagaaggaccaagaggtccgcatcttccgcgacacgcccgcccaggtcccggacacacagttcagccagggcatcccgttcctgcctcgatacatcgacgcgaacaacaagcagctcctgtacgccgtgcaggagggcatcaacaccgcgaacctcgctctcgacggcgtactcgacgcgatccgtatcgcggaggaagcccgtcgcctggcacaggaagcactcgacgccgccaatgaggcgctgcgccgtgccctgggcttcgccgagattcgcaccgtgaccgaggactcggacatcgatccgagctggcgtggctactggaaccgctgcatcaccgccgacaagcccctgaccttgaccatgcagatggaagacccggatgcaccgtgggtcgagttcagcgaggttcacttcgagcaggccggtgtgcgcgacctgaacatcgtagccggtccgggcgttaccatcaaccgtttgcagaacaccaccatgcagctctacggcgagaatggcgtgtgtaccctcaagcggctgggcgctaaccactggatcgtgttcggagccatggaggacgaataatgcgcggcattatcgcgggcatcatggcctcccaaattcgacggcccaagcccatcctggcgacctacccgtatcccattctggctacggacgacgcatgggctactaagcctaacatagtggcggcgctgacacgcgacactttgcacgaggttgtgaaccagccaggagaggacacctaccacgcaacctccagtgtggtcaatgtgctgcttcggtcgctgactcagctcggctacgggggtggcgacgggttcctgaccgcacctgccgtccatgcagccctactgcgcgatacggttaagagttacaccgcagagccttacgccttcttgtcgcagaccgcagtggccggcgcagagcttaaggttgtggtcgtctactctgagtacatcgtggagccgtacgccttcgccacttcgacagcaattaaacaggcggaactgaccaatgtttgagacacgtgttaagggtcgctacaccgtgacccatctgaaagccacgggtgaagtcctggcacagtacaccttcgacaacctcatcactaacgcgggccttgactggatttgcgccatggatacctcggacctgttctcacaggccctggccgtgagcaccagtacggcagaccctaaccccgccgcaccttccctgcccgaagaagtccggcgaaccacttcctatgccccgaacggggacgtaacctcgggtctggacggggagtggatttactggcacaagcggtggcgcttcccgataggcactcttaccgggcaggtactggccaccgtgggtattgtggcccaatccgaggtcgggttcgagagtaacactggcgcgaagattccggcagggactccgctatcctacacccggatcaaggatgccgccggccaacctaccaccttggtagttcaggccgacgagattctcgacgtacagtatgagctgcgcagcaaggccgtggcgatggccgaggccaagttcgtgatctccggggtcgagcgcaccatccgacttactccgctgcccttcgcgaaccgtcgtaacctctacggcgagcgctacatccgctacaacgagagtccgcggatcgacggcaagaatgcgtcgggtgcggatgtccaagacggccaatgggtgaagctgtacccgcgatatactcgcggcacctacaagggccagcttatgctacgggccaccgtagataacggcaacatgccggggggtatcaccgggtgtaaggacctgaagatttacaacggtcggaactacgcactcaccatcgaccctcctgtagtcaagaacaacactcaggagttctccattacgatggagttctcggtggcgagggcataacccatggcactgatctacgacttcaacccagacctcgatccgaaggctaagtccaagttcgtaggtgcgcgaggccgtagggacatcagcgatgtgctggacttctgcgacgggggcgtggccatccaggacccatcgcagggtatgatggtccgagtgtggcgaacagagcttcgccaggacgggacctacctggggcacgaggacggctcaaacgagattcgcatcggtggcggtatcgctgacggtatctccacgatgtcgctcgacttcgacagcaacatgaactatgtgtgtgctttcgtacgggctgatcgtaccggtgcaatctcctacttcaacgtgcagcagggtcgccggctcctcgtagagctaggtcaggttgactatgccaaggtggccttggacgacaaacgtccaggggctaccgcctgggcgcaggtcatcgtaccctacacccgtaacggcaacctgtacgttcgcacacagaacgagaactatacggaagagcacctggaggtagataccggcaaggtattccgcccgctggtcaaatgcggtatgggcaccaacctccgcttccaagtccaattcagagggcatatgtaatgagcaaaaagcagaccgcgagtgctgagcggctgggcctgcttcacgagctggtctgcaccgctatcgagcgcaacttcaagtggtacatggacaacgacatcccgatccccgcgtcggatatcgccgccgccaccaagttcctcaaggacaacgagatcacctgtgatccgtccgacacgatcaacatcgaccgtctccgcgaggagatgcggcaggcgcaggccgagaaccgccgtatcgcgctggagggcttcatcgccggtgagaccgacgacgagatggaacgtctgtacactcactaaggaggcagcatgacgccgcaagaacgattccagatagcccacgaagtgcgggacatgtacccgcgcttccgggacttctgcctggacgccatgctgttcctcggcttcaagatgacgtggatgcagctcgacatcgccgacttcatgcaggactcgcccaataaggcgatggtcgctgcacagcgtggcgaagccaagtccaccatcgcctgtatctacgtggtctggtgcatcactcagaacccggctacccgcgccatgctggtatccggctccggtgacaaggccgaggagaacggccagttgatcacgaagctgatcatgcactgggacctgctggcatacctacgccccgaggcccgcatgggtgaccgtacctcggccaccagcttcgacgtgaactgggcgttgaagggcgtcgagaaatcggcctctatcaactgcatcgggatcaccgctgccctccagggctaccgggctgatatcctgattcctgacgacatcgagaccacgaagaacggcctcaccgccaccgagcgggccaagctgacgcggcagtcgcaggagttcacctctatctgtacccacggtaagattctctacctgggcacgccgcagtcccgtgagtcgatctacaacggtctgccggcgcggggcttcctgatgcgcatctggccgggccgcttcccgaccctggatgagcaggaacgctacggtgactggctcgcaccttccatcctggcgcgcattgcccgcctggaggagaaaggccacaacccgcgcaccggcaagggcctggatgggacccgtggctgggctgctgatccgcagcgctacaacgaagaggacctgctcgacaaggagctcgaccaaggccccgagggcttccagcttcagtacatgctggacaccagcctcgccgacgagcagcgtatgcagctcaagctgcgcgacctgctgttcatcgacgccacgcatgagagcgtgccggagcaagtggcctgggctgccgatgagcgcttcaagctcaagttcgacgcccaccgattcccggtcatcaaacctgagctgtacctgccggcgctgatggctggcggctgggcaccactccagcagatgacgatgttcgtggaccctgccggcgacggtggcgacgagctgtcgtatgctgtgggcgggactcttggcccgtacatccacgtcgtgagcatcggcggctggaagggtggctttgccgaggagaacctggagaaatgtattgccctggctgcgcgttatggcgtcaaggtgatctatgtcgagaaaaacctcggcgctggtgcagttggccagctcttccgcaaccacatgcgatccatcgacccggacaccaacaagccccgctatgaggggatcggcgtagaagaccgccagaagtccggacagaaagagcgtcgcatcatcgacaccctgcggcccatcatgcagcggcaccgtctgatcttccacgtatcggcgatggattccgaccacgtggcctgtcagcagtacccagcggacaagcgcaatgagcgctccgtgttccaccagattcacaacatcaccaccgaccaaggctcactgccgaaggacgaccggatcgatgcccttgagggccttgtccgcgagctagcacccacgctcgtgaaggacgacgaagccgctacccgcgctcgtgaagaggccgccaagaaggaatggctgaacaacccgatgggttacactaagtctgtccttcggtctctcggcatgggccgggagcgtcgcaagggccgcccaaaaggacgaagactatgatgctcgataccgccaccgaggcgggcaaaggcaccctcgccgtcaccggcgtggggatcgccgtttactcgccctatgagatcgccagcctctgtgctgcggtactcaccgcgctctacgtgggcgcccagctcatcaccctgctcccgaagatgctcgatagcatcgcggagcttcgccggaggttcaagaagtgaacaagcccctgcgcggcgcagcccttgcggctgccctcgccggccttgtcgccctggaaggtagcgagaccactgcctaccgagacatcgccggcgtacccaccatctgttctggcaccactgccggggtcaagatgggtgacaaagccacaccggagcagtgctaccagatgacgctcaaggactaccagcgcttcgagcgcatcgtcctggacgccatcaaggtgccgctgaacgtcaacgagcaaaccgccctgacgttcttctgctacaacgtgggtccagtctgtacaaccagcacagcgttcaagcgcttcaaccaaggccgcgccactgagggctgccaagccctggccatgtggaacaaggtcacgatcaacggccagaaggtcgtatccaagggcctcgtgaatcgccgcaacgcggagatcaaacaatgcctcgaaccatcgtcgcaatactcgtccttgctgtggtagccctgggagcctcgtacggcttcgtccagagctaccgggccttgggtatcgcccaggaggagatcaagcggcagacggcccgtgcggaggccctggaggtgcggtacgccaccttgcagcgccacgtcaaggaggtcgctgccaagaccaacacccagcgccaggaggtggaccgtgccctggaccagaaccgcccgtgggctgaccggcctgtgcctgctgctgtcgttgacagcctgtgcaaccgccccggcgcccgctgtgctgtgcgaacacccactgattgaccctaccacccaggctggcctaatccgcgctgtagcggcctatcaggacgccctggacctatgcaacgccctgaatcaaggagattgacatggcgaacacccgtgagcaatacctcgctggccgtaacaccagcctgaccttctaccaggtctgccagcccggcaccgacaaccgcatctccctgcacgacatggacgaggccgatgtcaaggccaaggccaccgctgtgatcgcagcagccaccgccctgggcggcgagggtggcgctactccaccggacccgctcaccgcctacaaggtgaagaacggtgacaccctgcccgtggacggcggtggttccgtgaaggtgaccgtagccaacggtgctatcaccaaggtcgtatacaccgcaccggcgggctgagctacagcccgtccaacctgactccatccatagcacaaggaactgaaccatggcaaccttcgccgctgcaactcagaaagacctccgcgccttcgccggcactatcgagaacctgatccgccctctggaagaagcggccctgggttcgggctacaacgccaccttcaaggaggtggagaaggacgatccggacaaccctggtcagaagatcaaggtgcaggtcatcgacaagcgcatcctgcgccccgaactcgtggctaacctcgacgccctgatggccgctgtcgagaccgccaaggccctcgtgttcaagtaaggagacaccatggataagcgctataccctgggcatctgccactactccgcagtggacaagcagacgcccgtcaccttccggtgcagctcgctggccgaggtggaagccatcaaggagcagtggactggcggcaagctcgcacagtaccactaccacctggtagaccattgggcgaacgggcacccggattgtccctgctgctgctctgagtagctcaagccgagcacctgcatagtcgggtgctccactggaactactggaatttttattgaggttggctggcgggctggtctgtggctggcatctggctgggagtagttactccgggtccaattttgatatcgtcgtgtgagaaccctcccgactctgatcagcccacccttcccccgtaggccctccgcctggtgggccatcgcctcgcattgcctgggtggtgctgcctgtcctcctgggagcttccggcttcgccggggtggcggtggcttccttgcccttcgccgcccattctacgcatcctgccgggagtgtcaacccttgggctatcgctgtcactctaccgggcttggccgtagtgcctggagcgctctatcgcctcctggtgcctggctacggctagcgctcggtctgcctctagggtcctggctacgcctgggtagtgcctggcatcttccctagcccacttggctagcctgcgctgccaagctgcctcgtgctggtgccaggctcgctcggctcggtcctgtctgctcagcatccttgtgcctcctgtggtggtctgcggtcctgtcgggtggtggtgcggga

SEQ ID NO: 18 - DNA, 65672 bp, Myoviridae Pbunavirus
  misc_feature (1)..(65672)
aatcctaatagaaaaaatctatcacggacgttacctatctttaaaattaataaaattaatagtaatttggtaatttggtaaactttagtatttgaaagcctcgcggcactaagcttgtacatatcccgtcaagtttccgattccagccagctcgcggcagggtcgccggaaacttccggacttccaatccatgggtcgcggcaacaccacggcggactaagcggcaagtgccaaaactcgacgaacggaaccggaaatttgggagcgcgatagaatcgctcagctggacatatttctaacattcgatttaacactcaacccaaacactcaccaccaccatcgcccgccaccagccaatccgatcctcacccaccagcagaccgcccatataacatcctataacaccacctaacactcattcatcatcaaacccacccagacctacagcccacccacaagcagcccatagacgcgatccctggccccatagtacaatcgcgccatactcagtgtcgcgacagagcaccaggccccatccaccaaccgagccaccgcgacgactccagaatcgaactcagggacgcagcaccaaatgaccaaattctacagccccgacgatctagtcacgccacaggaattcgcagacccgcatttcgcggcgatcaaccaaaagcgattcgacctgtacatcgacctgcgcgtccaaggttacagctcctggcgggtcttccgggccatctggggcgaggagcatatggacggtcccgcgcaggcccgcatcttcgcgatggagtccaacccgtactatcgcaagcagttcaaggccaagttgaacgcgaccaaaacgtccgatttgtggaatccaaagacggcgctccacgaactcctccaaatggttcgtgaccccaccgtcaaggactccagccgtctgtcggccatcaaggaattgaacgttctggctgaaatcacgttcgtggacgagtcgggcaagacccggatcggtcgcggtttggccgatttctacgcatcagaagccgaggctcagaccgcgaccgtcgctgctgcggccgaagccaatggctatgttccggaaggcgaagagggcgatttcccgtccccgacgccggaaccgaccgaggaagatcgcgccaaccccatttagacataaaataacatcgttctaggcccgaatcggaccgaactaaggcgacggtagcgggaagggacgaaaaacgattctagggcggttctaggaagtcggagcctaaccctcagaaacgacaaagcccccggactctagctcagaatccgggggctttcttttgggcgccttattcgccagcttcgatgatttcgaagttgtatttgacgccttcgtgctcgaaagtcatcttgccagccgccttcagctgcatgcggaagcggatatgtttcgaagaaggcaggccgaactcgatgaatgctgcgttggtggaccggaactcgccgcgcttgcctttgacagtcacagccacgccatggcgctgagtgcgtttcttggaaacttccgggtctttccaggagttggcgatggctgccgacaggtctttggactctttggctttctccggagcgttcttggcctcttcgcgcatcttccggatttcttccagcgcttcctcttcggtgatctcttcttcaggcttcagattctcttcctcggccttctcttcttccttcttcttcttggaagtgcgggttttgtagactttggccggggcttcctcttcctgaaaggcttcttcctcggccggcagagcattcaggatggcgaggcagcgacgctcagcagtcttgcggtcagagaaacgcttgacggtcgcatcggcgttgtgagcgttgtagaaggcgaccagttctttcatttctgcgttctggatgtcgccgaaggttttgatggagttggtcattttgcgatcctctgttttggaagatttcgttcgggcttcggtttgtcgccccgttgaaagagattatgcctaggtcgatgctgcgtgtctacatttatttcatcagattgatcgcaaagccgacgaacggttgtctgatgtgaaaacaccgcagagcaggttgcggtgtttggtgggcgagggcgatggtcagaaagtcgggactgtgatcggctcgattggcgggtcgccgggcctgtcgttgtccgatgcgggcgccgggctggaagggatcgcacccgaccgaagcgccagcgattccgactgcctgcttacctgcggagctggaggcgcttttggcgcatgaggcgcgggcggaaccggcaggcctggaggagccatcggcgccctgggcggctccggaagatcgggcagatcaggaagactcggcgctatgccgccaaaggaccgctgcgaccgctgcgacggattgtcgccgaacatttcggcggatcggttgtccttgatgacttgacctatggcagtcttgtcgccacccggttctgctggatcgaagcccgtgaatggagtggtcacgcagcgcatgttcggatgggtcggcagattgttcaggacgatggagtccgcccagacatacgggtttttgtggttgccgggtccgtggctgatgatctcggcaggaatatggccgttcatggtgagccattccgccatcccttgccgagtcagcgggcttaccacgatctgaccagtggactcttcggcgacggcgaacagatcaccgagcttgaatccgatgatcatatagttggacctggactcgccgacgaaagccagagtttcgatgttgtggtggatatcttggtcttcccagatgtatagcatgatgtactcctcaataaggctgcttgttgtgctcgaccagagacataccggccggaactttgaagcggatgtactcgatcatcatcgccgtgcgacgccgattcgtgccagactcgtcattgacgaagagttcgcactgatgcggaatgactcgcgtcaccaggtcttcgcctttcgagccgtagaacttgatgtaggctgcgacgcctcgcgtcatgttcagatgaatcgtttcgcagagtcgctgcgcggccgacgcgctagacagatcggtcggactgaccgtcacccagtaatggccattttgttctttatcggacatcaactgccctccattgataaagccccctgccgatccgcagaggctggttgttgttagtcgcgcttcaacagaacgactttgtcatatgcgcgatatttaccgcgccagtcttcccagtgttcgccggccgggcagacaagctccagagtgatttcgtcgcgccagcattcgacggaaaggacaatcgccttgttcctggctgcggaatctgctctgagcttaatcagaatttcgtcgcccgttttcagttcatcgactcttaccactttggccatcatacactcctatgagaaggcgcggccaggacgatcccagccgcgccgatggattaacgtttgtgaaggatggacactgcgtccacgtcgaggatgctgatggtacggcgacggcgcggattgctgcgttcatggatgcgaatcaggtcagcggatggagcttcgtccaccacccatacatcttccggcttctgcgtccggagcaggaccgttacttctgtgttctgggcgaggccgttgcagatgaacaagaatttggacgagggagttctgtacatgtcgagattcctttttggacttcgggtccggcttttcagtcggtgaagagattatgcctgatcatcaccgtcgagtaaagcacttatggaccaattctccagttaaatggaaccacagcgcggtatcgctgatcgctacgctcccacgccatggcccttcttgcttacatacttcgaaccacaagctgatttccatccttgccaggactcggccgaaggattcgagccggcgccggctagccaggatgtcgacattcaaccgccgattgatttcgtatcggcgaccgtttatgacgaagaccagccgcagggtttgtccgtcaagacactcccagtatctggtttcatatcggagccaatagcgcttgccagccgggcctaccatggccatttaatcgatgctcctggccgcgccacgcggtccggtcggcgggacgggatcgaaccgacccaggatgtagtcgggccggcgcgcttcctgaggacacacggcgagaaggcgccatcctgcgtccagggcagactggagttcgtccgtgcagcagtcttccttgagcagcagacggttgacgttctggagattcggaccaggtatggccgatcctgtgagtgagttccaaccctcgattccactcaccatctccggttggttgatgtagcttacggacataccggccaaccggctcgcggccagctccagacgctccagcatgggtcgcagagcagcttccgggtcaatgtcgtcccagagaaggaccaggctgatgatggtatacggatagtccttgtccagatcccaggctgaagcggtcaggcggcccaggccgatttcattacacataacgggaacgtcgctgttccaggtggacggctcccagttccgctcaccaggattcccgattgttacgccttccaggttccccaggagaacgtggagcttgctgacatattccgcttccaaggctttccgctcttcgtcggtctggttgtggcgatagaaggatggagggctgacttttgcatgatagagtttcataactgttcctcggttttggaaggcttgaacgttagagaattgtgtcgcagtatttctcgaaaggactctgacgcttcttctcgcagatcgcacaggtgatttccaggtcgggcagctcgctgtaagtcttgccgagatacaaccagcgcttgcacagactgcggccgtccgacgtgaagaagtggactttgcgagcattgccgggttgcgcccagccgcttggtgccggcttcctgctcataccatcaccacgtcaatttcgtcggcgaagaagttaaagccaactccatctgcgtagccagtgtaacgcagacgagtcgtcccatcaatgtgggcttcctcgacgccgatgacttccagggtggtatcgttgcagtacagcttgacgaacatcttgatgccggagccaatcgccgcgaaggcgatctgcttgtacaggtcttgcttgatcatgctttacgctcctgtttgcggatgtattctgccctgacttcggcttcgaacttcgcccagagcgcgttgtctactggaccccagggaccggtctgagttccgtccaccggcgcgaacttgccaccggcgcgacgatacttggacagcgttctcaggctgatgattttctcttcttgggaatcgaattggacgatcacttgacatacttcccgaagtagcaggtgtggagtatttccaggcctttggagatagccttcagcttgatgccgaaattcttgatcgcccagtccagatcgtggtgatagaactcgatgatgttgacgatttgaccggcgctgtagtggatgacgcgaaccttgccgttccagcggaaatcttcgcggctgtttacggcctcgactgcgatggtgtcgtttctgccgatgttccatttggagctagtcatgtcgcaatcctctttttggagtgtttcgcgttcgatgaggtaactatacctcagccccctcatcgagtaaagcattttcttcagattatctgaaaccttttgaagacaggaattgccgccagagccagtcgatgtgttcgttgcagtaacgctcgccatcggacgacatagataaggcgccatcattgatgccgaagtgggccgcagcgagacattcgaactcgaactggagcgttcctgggcgagggatatgggacatggcgtatttctgcacggtcagtgatcctcagaaggtttagcgtttgcgatagccgctactttctgcataccgaggcgatagaaatcggcttctttcctggcttttgtaagctgctccatggcgtcgcacgccgtcttgtgctgggcattggcgttcttgatgctgccttccaggctcttgtccagctcttcccggagcgccttctgcgatgctagctctgcctccaaatcctggattctgagctggagctggcgatttgtctcgccaacctggttttcgctggcgatggagttctgaaggcattcgtcaaggcgagtgttttcgcgcaccagctgatgcttttcgactttcgcctttctgcacgtctctcgcatttctgaaagctcaatcgcatgcagatcgtcatccgggtctttacgctcttccttcgactccatccgcaggtagtactggccggctgcgaaggcgagcactgcctggtcggcatacgccgcggcatcggtcatgtatctggatttgtagcgaggcagaaacttgcactcctctggatcccagaggagactatcggcaataggccagaatttgcggaagccatcaggatcgacttctacattgaccatttgcagctggccggcctccacttcgacttccagaggaacctgaatggcgccggtgatgtactggaagtacactatgctagacataacacaatcctcataagaagtcgcggccgggaccatcccagccgcatcgtaatcactcttcgccttcgtccgcgctcagccactcttcgaaggcgaaatttaccttagactcgacccaatcttgaagctcatcggcgaactcgtcactgtcgatgtccatcggaatgcccagagtctcttcgttccacagttcggcattcagttcgaactggatagccggttcgccatccacattcagcaggatgcggtctgcgacttcatattcgtcgacatcgaagaggaaaccgccgctgatgatgtgctggatgaaagcttcgtcgaagttgctgacgccgatattgatctgcttagtcattttttctggccccttatttggcgagtttgtgctgagctttgagggtggtcagcttagctttcagggcgatcatagcctggccgcgcaggccttccatttctgcctcgctgatggcgatcttggcggagcggatttgatcgttgatctgggatttggtcatttctgcgttcctctgttttggagtgtttcgcgttcgatgaagagattatgacgctattcagaatggaagtaaagcagaattgtgaaatatttctcaaagtggacgaacggtatgccccgtcaggaatatttcctcccatggaaggcatttccgcatcagaatgttgattaggtatcccaaagcgcgcagtggcgaatgtgagtccgcacgtacatagggctgtattgtgcgaagtgctcgacggtcgcatccaaggctctgctattgccgcacccttccgctttgcgagccaggaagaatgcttctatttgctggtttgcgttcatcgtcttaccctccaggtgtttgttcgtttcgatgaagagattatgccgttggtcagaatggaagtaaagtgtattaacaataaaattatgttcaccgacgaacggttgtgctcgaccgtctgttgcggcgtcgatatactcgacctattgctgacaccggattgattagaatgtacaaactcaaccctgcactgcgagcggtctggcgaactcgcgcccgttacaaagtcatttatggcggccgggcgtcttcgaagtcacacgacgcaggcggtatcgccgtttacctcgcggccaactatagactcaagttcctctgtgctcgccagtttcagaaccgcatcagcgaatcggtctacacgttgatcaaggacaagattgagaattctgagtacaacggcgagttcattttcacgaagaactcgatcaagcacaagaggaccggatcagaattcctattctatgggatcgcccgtaacctgtcggaaatcaagtctaccgaaggcatcgacattctctggcttgaggaagctcattacctgacccaggagcagtgggaagtcatcgagccgaccatccggaaagagaactcagaaatctggatcatcttcaatccgaacgaagtgacagacttcgtgtatcagaacttcgtggtgaagccacccaaagacgccttcgtcaagatgatcaactggaacgaaaatccgtttctcagtgagacgatgctcaaggtcatccacgaagcttatgagcgcgacaaggaccaggccgagcacatatatggagggattccgaagactggcggcgacaaatccgtcatcaatctcaagttcattcttgcggccatcgacgcccacaagaaactcggctgggagccggccggatcgaagcgcatcggcttcgacgttgcggacgacggcgaggatgcgaacgcaactacgctcatgcacggcaacgtcattatggaagtggacgaatgggacggcctggaagatgaactgctcaagtcgtccagccgcgtttacaacctggcgaagatgaaaggcgcctcggtcacttatgactccatcggtgtcggcgctcacgtcggatcgaagttcgccgagttgaacgatgccagtcccgacttcaaactgatctatgatccattcaacgcgggcggcgctgtcgataagcctgatgatatctacatgaagctgccgcacacgacgatcaagaacaaagaccacttcagcaacatcaaggcgcagaagtgggaagaagtcgcgacccgattccggaagacttatgaagcggttgagcatggaaaggtttatcccttcgacgaattgatttcgatcaactctgaaacgattcacccggacaaactaaatcaactgtgtatcgaactttcgtcgccgcgcaaagacctggacatgaacggccggttcaaagtcgagtccaagaaggatatgcgcgagaaacgcaagatcaagtcgccgaacatcgctgactcggtgattatgtcggccattctgccgatccggaagcccaaaggtttcttcgacttctaaacacagaaagcccggatcgctccgggcttcgggtcttactcggtgtggttcctggcgctgagtgtcgacgcaacggcctcgccgactcccagggcttcctggccggccgcgagcgcttcggcttccgactcgacgatgaaatcatcaccttggccatcgcctggcggaacctcgaccagcacggcttcttcgccttcgaaccgcaggtcataggtcttttcgacggacagaccgtaacgagcgttgagcgcgtcccagagctgggcctcataggtccgcaggtcttgcagagctttctggtggctgagcatggccatgtcaacggcccgttgcagggtttcgtccaggacgttgaatcgcatgcgaagagaacgaatccgctcgaccacttccgcatccactacatgcctttcgatcatcgcttttcacctttgctgaatgtaacgttgtagccgttgtcggccaggtaggtcagggcgccttcgaaggaagttccgacgaggtgctttagcttcatttcgcgttgcgcggccagccagaatgcagttccggagaactcggcgcggccttcggccaagaccctgccatcaggcccggcgatacgtacatggacggaagatagcttgatcggcatcagtgaatacctccactggcttgcgacggcatgctttcggcgcgcgcgcggcttcgcagtccgggcagggacatgcttggcggacgcgctccagctcgtcggcatccatgacatagagcttcccatcggcagtgtcgtgcgccatggcgatgttcgggaagtcggtggcgctcaggccggcgacagcgcggatttcgtcccaaagcaccagatgctcggcattcagtcgggcggcgagcgcttcgtgctctttagcgacgcgcgccatgaactcgtccatccggaatgcgaattccgcatcgatggcacgggccgaggccatggagctgagtcgaatcggttctttcttcatgatgattctcttttggttggtggttgttcgctgctcaggcctattacagtctgagaagcatgatgaagatgaacgcaaggaacgcaaacggcacaagtatgccggacatcagctttgacaggcgctgcatctcagcgtatttctcggttgacattccgtgctgcgccgcctcagccgcgaagcgggctttcgcctcgataacttccgggcgcagcgacaggacatattctaaggcctcttcccgcgctttttcggcctcgaccagcctagggtcgcgggccgagacttcgctgtaccctggccttgcgggatgggcctgcagcgatggaggaagttcggcggccacgactccatagtcggcgcaggcccaagcgatcccgatgaggatcgcgaggatggactggacgattcgcagcatcactttgtcgctaggaaagcccatggttaatcctccaccgaccgaatgatttccatgttgcgaccggcattggtcccggcagtgtaggcgcgccgaccgtcactgtcgtccagacgcaggagtttggtaacattcgacttcttgtaacccggatcgccgaaatgttcgtggaccgcagcttccttaaccaccaccagagacgttccggcagaagataccagctccatacgcttcctggttatggactgaaggcgatagctgatttcctgggtcgcggccagtttgaattgcgcggcaacctttacgttgaaacgttcgtacccttgcgccttctgatactcccgacacagacgatcaatggcctcgaccagggagttgaacatgttcaccgccagctcaacgtccgacttgtagcctttgaagcgtacggcatgaccccagcgcttggtagtgcttccgtcgcgggcgctcctggatgccttagccgatgctctgtggttgttgatgccaccggcgaaatccatgatgcagtcattgtacgtcgccacggccactgagaaaaacttcatccagttcgggattgcggaatagtaacgagtggcaatttgctcatcgaactcttcgcgaatctcgccggtagcttcgaagtcgtgaaggtcatatttgtccttcaacttcttcacacgctcggctgcgatggccgcttcgtgcggactggaagagtcggctgccatggcggtcagtttgcggatgcggtctttcgccttctcgatggcttcaggggtgaattcgttctggtcggtcatggtcggttccttttgtctgaagggtttcgcatttcaatggagctattctgccttcattcagaatggaagtaaagcactttcttccactatttcggcatcgactggaagaaattccagatccaatcacctgctaccagcaagaggatgagggcggcaaagaacaagacagcggccgcgagctgtgcgcccggcttcagtttgggatggctgagcttgggctctacgggaacggccggagcgctagcgctgcaaccggcgtctcctgggccgtagccgatgccgcgttcacacgcctggaacgacaccagggatttaagatactcggtctgcttttgcgactcttcgtagatgccggcgacggcgaaccagagggcgaacactacggacgtacacacaacccaggcgccggtcagcaggagggccagcgggccgatgacgaagacggtagcagccaggacgattgcgccgccccagatgatgaagccggccagaccattagtgatgtcgacacagaactttttcattttcagattccttcggttacgggatggaggggatttgaaactctgcgccgccgagaacatcaatgacgacttcccagagcgtcggaacagaccactggtaacggtcgaagtcggtttcaggatcgacgcccagcgtcacataggaagtggcaggccatttatgaacactgcctttccgcatgagagtcgccacgcggccgtcaccgagcggattcgtcctgtgcggaacgtacgcagacatcgaatattgctgcccggcgtcgataacaaatctttgcctctggcgcagacatacagagcccacaggattccagccgcgaccgccgcaagcctggcgagccgaagaatgctcataaccttcgtgagtcatttcgccgaggcaagccgagcgatcctcgtaatagttgatgttctccatcgatccaaccagcaccagagactcgaaatcgaatcgatgatcgtggatggccgagtgattgaagcaaagccgacgcggcagctccgggtgccaaacatggaggcgaccggccggaagttggacctgaatgaaccccaggccgtgcagagtgatcttgtccttcatcgggtcatggacggtgctcatggataatcctcagtagcagaaatgtattgtgagagttacgattgataagccggtcgcccatagaagggcgaaccaggccatggctttgatggtcgtgtagatcatccgaagaattttccggcacagatcgggccaatgcccatttcgatggatgcgtggttggtcaactcgcgaccgcagcaggagcactgaccagtcttccgaccgtaggcgactgccgattccatcggcttttcgaacatcttcagaacgtcgtcgtgctcagtatcggtgcagtcgcgactcttgatgaatttgccatcggtgatccggccgaggtagatgtcgcccaggacgtacaggctaccggcgttccggctgtgagcgctagcctctttcacaacaacgatgagcggctcctcgccttcgccagctaggcggattttcgggcgcttgataccagactctttcgccttctcaaacgctttctcgatgccggaaatgtccagagtcggcgcagcagcttcctgcgcggccactttctcgcgatacttggcgaggttttcgatggcgcgcttcgcagcagcgatctgattttccgtcaaggagccgtatttatacaacgactcctgaaggctctgagcgaagctgaaggaatttccagtccaccactcgatgatatccgggtgcgcggcttcgaaagccttaattttgaggtcgcgttcttgcgcagcgctacagattttctcggcgcgcttttctgccgccttggcacggctcttggcgcgctgctccgggctggttttgtactctttgtatccgacaccgccgcaggcaaagcaggcgcgaccataagatgaagggccacggtacaggccggtgcctgcgcatttggtgcacttgtcgcgatacagcttcacttccttccgggagttcgggcgggcgcccatggacacatcttccagcgtcttcggagcttcgtcagtgatcgctacggtagcgaagtcatcgcccaggtcttcgaagccggtgaacagattctctgctgcgttcatgtcgattctcctgtttggaaagttcgtttcgatgagttgactatacgccagaaatggaaaaacggtagcgttttctcactaccgttcgtcgggtcgaagacaatcaataaatgtcgctattgatcttgaacccatgctcagcgccgtcgttgtagtcgtactcaacataactgtcgcagtagtcgttcaaatgctgaatgatgcctagaacgtcgttcgcggccttgtgccttttcgcggcgatggtcttggcgatgctgtcgccgacttccagggcttcggccgtccggcgatggatcagcaggcgactccaaagatagagccggacgcgacgaatgatgtcgcgatggcgctccagtcgtccgtgcaactcttcaatttcgtgctcgcgagattttaatactcgtcgaagctgttgaacttccaactccaaatcggccttagtagccatgttaacctcagaaaggaaaatcgtctgagactccaggaagctcgacgattattgttgagcctgatcggtctagaatgcatccgaccgagccagccctgtgtggatagggtctacacgaactataacaggtgacttccctgactattcgccaggtcgatcctccacaccatctgcaaattggcgggcgcttcgacttcagttttcgttcgtccaggacggcgcgtctgtcgcaggaaaggcagcgtgccttaaccgacgtaaccattggtatagtcgatcattcggatgagctcatcatcctctgattctctcgacttcagaccgcccaaagagtccgactggccgtcgcatttcgcatcgatatccatcgaagacaggaatcctgccgatactgcggtgatatcaactttgtcgccggccttcttgaagccttcgcactcagcatcgagggccacaattgcactcgcggccatgttcacatgactgatgaggtcggggaagatcacaggaacttcacgcgacatgccacggaccgtcagcttcaggactacatacttcatactcactatcccttttgtatgtgaggaaagaacttgctgttttccggatggtgaaaacgctcggtcgcaggcggtctttcttccggacattgaatcgtcgaaggcgggaaaaccgcgccggcgataatcgccgcgaggagtgcagcggatgtcgacatccagagggcggtttccaggctcacccgaacttccggacggcgcggcttcattcgctccaccctcttcctggctcataggatggcagaccgccgccgcgaatccaattgtcccacatacggttcagaccagtcggcggctggggcggcggactgtagaatccgggagtctcagtgctgctcaggaaataaggcgtgcaaacggcctggacgaccaattggtgccgctcccacatcttatcaatcgctcttagcatgacgtcttcgcactgagccttactgtcgaaccgtctgctagtatggtccggcatctggacgcagccgtctccagtgcaaaggaaagcagtagcaatccatacggtgatactcgccatttcgtcaccctctttagttgatgagcagagtctattccatctgctcgccaggagtaaagcgcttttcgtcgggataaatgccgatgatgtctgcgtcgagcatccaaatctccacggacggatcgtcgctgctgatttggtacaggttgtacagctcccgtccgccgacagcgcgctcgcctcgcggctcaaccgccagaaccttgccgtgcccttctccgtgctcgtccaggtatatgacgtgatcgccgacttcatagctttctttcgtgacgaggcgtgaacgcgagctgttctgcgattccactacccaggaatccagcacgccgcctttcatgtcgcgaaacaatcttgccgatttgtcgcaatcgaatacgcccagaacttcgccgtctttcaacacgatatgtacgattggcaaaagagtattcatgtttaatctccattggttgataattagagtctaatctgccgaaaagttcccgtaaagaattattttctcataactgattagttgcaactgttaatctgatgtatatgtttgaatctcttttgaacgtttgatgtttcccctataataagcgcacacagccaacaaccacgtggaactacaatgtttaaactttcctggatattcgggcgcaaaaaggataatgctgcctgttctgaatcggcgccggagaaagtcgcaaaaatccctcaacacgatccgctcgacccaatgatcaagctgggaaggattcgcggctggaacgtcgagccggagaaagccccggtaattcgtagcgtgaaagatttcctggagccgggcctatctgtagcaatggatagtgcgtatggtgatggaccaactccggccgcgaaggctgctgcgggcggccagaatccctatgtcgtcccgactatgttgcaggactggtacaattcccaagggttcatcggataccaagcttgcgcaatcatttcccaacactggttggtggacaaagcttgttccatgtctggggaagacgcagcacggaacggatgggaactcaaatcggacggcaggaagctatccgatgaacaaagcgcgctgatcgcccggcgcgacatggagtttcgcgtcaaagacaaccttgtcgaactcaacagattcaagaacgttttcggcgttcgtatcgcgctgttcgttgtggagtctgacgatccggactactacgaaaagccgttcaatccggatggaatcacgcccggctcctacaagggaatctcccagatcgatccatactgggcaatgccgcagctcactgctggctcgacggcagatccgtcttccgaacatttctatgagccggatttctggattatcagcggtaaaaaatatcaccgcagccacctagtggtggttcgtggaccgcagccgccagatatcctgaagcctacatacatcttcggcggtatcccgctcacccagagaatctatgagcgcgtgtatgcagcggaacggacggcgaacgaagccccgctgcttgccatgtcgaagcgaaccagcaccatccacgttgacgtggagaaggccatcgcgaacgaagaggccttcaacgctcgcctggcgttctggatcgccaaccgtgataaccacggcgtgaaagttctgggaattgacgaagacatggagcagttcgacacgaacctggccgacttcgacagcatcatcatgaaccaatatcagctggtcgcggccatcgccaagactccagccacgaagctcctcggcacttctccaaaaggattcaatgccactggtgagcacgaaacgatttcttatcacgaagaactggagtccattcaagagcacatattcgacccacttcttgaacgccactatttgcttctggcgaagtcggaagaaattgatgtgcagctggaaatcgtctggaatcctgtggactccacgtccagccagcaacaagccgaattgaacaataagaaagccgcgaccgatgaaatctacatcaactctggcgttgtgtctccggatgaagttcgcgagcgtctgcgtgacgatccgcgttccggctacaaccgactcaccgacgatcaggcggaaaccgaaccgggcatgtctccggaaaacctggccgaattcgagaaggccggtgcacagtcggccaaggcgaaaggcgaagccgagcgagccgaagcccaggcgggcgccgtagagggcgcaggcggcccggttcccgccgctccacgcgggactaagcctctcgcgaaagcgtccgaggaaggggccagcgaggccgctgaaccgccgtcgaggccggaccccaaggccgagctgcggaacttgttggtcgatcttttgtcgaagctccaagacctggacgacattaaggcgccggacggcgtagacatagagcacaatgatgcgcctggcttaaagcgcacatccaaacctggcgtgtctggtatggagccttcggtgttttcgtccaaccgcatcgtcgggcctcgtgatcattcggaactccagagaatcaaggtgaatggaataaccaccttgatcgaaaatccgcgcggaagcattcgacaaggcaaggatgggagttggcgagttcagatgaaacaccactacgggttcatcaagggaacgaaaggcgctgatggggatgaagtcgattgcttcgtcggtccgaatctgggatccaaacgggtcttcgtcgtcaaccaagtgaacaaggaaggtcagtttgacgagcacaagtgtatgctcggcttcaacaacatcaacgatgcgaagtctggatatctgtcctgcttccgtccgggctgggatggtctcggctccatccatgaagttgacctgcccgctttccgtcgctggctggcgaacggcgacaccaccaaaccgttcgggggcgagtgatggcattcaaggcctccaaaaagcgcgagcgccgggcacctcttccagtcggaagagggaagcccataattccatcggcaggaatcgaggcctggtatcgaaagcagatgaaggatatgtccaagctcatgatctccgactatcgaaacgagattgagaaggcgctgtcccagcctgcggccgaacgtttcttcgccagagacgaatccgttaacgtcctgttcaagatgacccttcgaagcctacagcagcgatggagccgcatttttgaaggtttcgcggccaagatcgccccggagttcgtcaaccggaccgaagaagccgctaccgccgcgacccttcacagcttgtcggtggccggcgtcgatcagccacgagctgcgtataatgagagcgtcaggaacaccctggaggccgcaaccacttacaatcatactctcatcaccaagatccaagaggaagtccacgagaagatttacacatcagtaatgctgtctctgacttccccgaatccggaagagcaaggaacttccggcataactaacgcacttcgcaaagtcgggaagttttctgaagatcgaatcgaactcatcgcaagagatcaaacaagcaagctttacagttctctgagcgatgagagaatggcggaaaatggagtcgaggagttcgagtggctacactcttctgccggcaagactcctcgccacacccacctggagaaagatgggaagaggttcaagctgaatgaccccagactttgggagggtccgaaagcagaccaggggccgccaggatgggcgattaactgtagatgcagaaagataccagtcatttgacatcgataggagcgctatatgccgttagttcatggcacttccaatgaggctcgttctgaaaacatcaagcgggaaatcgaagccggtaaagacccaaagcaggctgcggccatcgcttattccatccagcgcagtgagaaagggaagacggcgaaagattgttcgcctgagctcgtcgccgatcttcgcgccctggtggacgctctgtcgaggctcgtgaaatgaaccgcaagacgtgccggcgccgactcgtggtcgatgtaatcagggccaatattcacggcggattcttcagcctgaagtttgccgccatcgatttggcaatcatcggcgtcgccatcttgatggcttttggccgatgatgctgagaaaaatctggattctgactaaaaattctagtccggatagccgcaagttaccgtttacggaaaatagcagtaatttggaaatcctactgccgcgaggctttaacagagccagttcctaatttccgatttagccgcatgcttcaaaagtatatagcctgggaaattagaagtaacgttccaatagaattcatctataagtaacgttataatataacgtcaatctatatgctctagacgtattgaaattcaatttttaatcggtaaattggtaatttgaattagtttaggagttgaaagcctcgcggcagtaggcttagacaaatcccgtcaagtttccgagaccaaattaccggattttcgcggctgaggaaactggtaattagatcacaatacaaattataatgtaagttaacagtcacggctacatctaattattgttccgcttatttacccttagatgtactgcgtatataatacagccatagtccacgactcttcgaattaacgatggcaaagtcgaaaagaaaaattgacgaaaatggatatatgaccatagagggctgcccgatcagctcttatggcgttttccaatattctgctggtcaactcggtcttccgggcgatccgacgcggattgtcaacgtatatcgcccggagtctgccgtcagcgatccggagtacatcgaatctctgaagaatctcccgttgatcgacgagcatgagatgctgtcgggattcgacgatgatgacgatagcgtggcccccgaagacaaaggggtggagggcatcatcacctccaacgcttactacgaagccccatgggctcgcggcgatatccgcatctattcccgcaacatgcagaatcagctggaaaggggcaaagaagacctgtccctaggctatagttgccgctacactgagcaacccggaatctggaacgggacgccttatgaagtcgtccaggacaagatgcgcggcaaccacatcgccctggtaaaagagggtcgtgtgccgggggccagagtattggatggtctgtgttttgaccatctcagttttgatttcagaccatccgatgagggtaatgaaatgagtctcaagaaagccaagcggaagccccctgtccagcgcgtagggcaagctgctgactcggcggtcgaagagttgcgcgccctgtggccgaagctatctgcgtctgtccagaagttcctgggcgaagaagagcaggagccggagcatcaggaaggcgcagctccggccgaaccgaccgacagcgagcacctgaccgagcatccgactctggaaggtgctcagaaggatgacgaagagcaggaagaggagccttccgttgtcgatccggccgtggccgccgtcgagccggagcatcaagaaagcgccgcatccgaaatgtccggtgaaggcgaagtcgccgaactgatctctcaggtcaaagccattctggctcgactggagggcacggtagccgaaggggcggacgaagagcatggcgaaggtcaagatgtcgtcgagggcttggaagagcagagcagcctcagcggcgcgcaaaccgccagcgacgatggtggtgagggcaaggataacagcgaggaacttcctgaaatggcacagaagaacgcgcaagatgctgcaattcgcggtctctatcgcgacattgctgctaaagatcgcctctacaagcgtcttagctccgtggttggtgcgttcgatcaccgagctatggactcggctgaagtcgctgtttacggcgtgaagaagctgaatatcagctgcgcgaagggccaggaagcactggcgctcgacatgtacctgaaaggtgtcgaagccgcgcgcggcgcggccagccgtcaatcgaaagcccaggattcggccggttctgctccgcagtgcgccgagctggacagctacctgaagggggagtaactcatgttccagaaacaagtttaccgccagtacactcctggttttccgggcgatctgatcgaggacggcccgaagcgggcgcggccgggtcgaatcatgtctctgtctgccgtaaatccggctgccaccgccaccggccccaaccgcatcagtcgcgctttcggttacgccggtgacgtcagctccctcggcgaaggtcagccgaagactatcgcggctcgcgcttctgaagtcgtgatcggcggcgccaacttctttggtgtcctcggtcatccgaagcactatgcgctgttcggttcggccggagactccctggctcccagctatgatctgcccgatggcgccgaaggcgagttcttcgacatggccaccggcctggtcgtcgaaattttcaacggcgccgcaaccgccctggacctggactatggtgacctggtcgcctatgtaccaaacaacctgcctaccgccgacaacgcgcttggcctgccggccggcgccctggttggcttcaaggctggctccatgccgaccggcttggtccagattcccaacgcacgcatcgttaacgccatcagtctgccggcccagtcggcggggaatctggttgctggcgttaccatcgtccagctcacgcagtaaggaggcgtcatgagccagatcagcaagacccattcgcgcctcgcaggccgcaatgcgaaacctttcgacctgaaaaacatcaccaatgacgccgtggcgtctctgcgccgcatcggcctggtattcgatcacgccgtcgtccaggaccagatcaaggccttggcgaaggccggcgcgttccgctccggctcggccatggacagcaacttcaccgccccggtgaccacgccgtccatcccgactcccatccagttcctgcagacctggttgccgggcttcgtgaaggtcatgaccgctgcacggaagatcgacgaaatcatcggcatcgataccgttggctcctgggaagatcaagaaatcgtccagggcatcgtggagccggccggcactgcggtggaatacggcgaccacaccaacatcccgctgaccagctggaacgccaacttcgaacgtcgcaccatcgttcgtggcgagctgggtatgatggtgggcaccctggaagagggtcgtgcctcggccatccggctgaacagcgccgaaaccaaacgccaacaggcggccatcggtctggaaatcttccgcaacgccatcggcttttatggctggcagagcggcctgggcaaccgcacctatggtttcctgaacgatcccaacctgccggcattccagaccccgccgagccagggctggtccactgccgactgggcaggcatcatcggcgacatccgcgaggccgttcgccagctgcgtattcagagccaagatcagatcgatccgaaggcggaaaagatcactctggccctggccaccagcaaggtggactacctgtcggtaaccacgccttacggcatttcggtttcggactggatcgaacagacctatccgaaaatgaggatcgtgtcggctccggaattgtccggcgtccagatgaaaaaccaagagccggaagatgctctggtgctcttcgtcgaagacgtgaacgcggccgtcgatggcagcaccgatggcggcagcgtgttcagccagctggtacagagcaagttcatcaccctgggtgtcgaaaagcgggcgaagtcgtacgtggaagacttctccaacggcaccgccggtgcgctatgcaagcgtccgtgggctgtggtgcgctacctcggcatctaacagatgcctattcaccaaaggccgggcttccggcctttgttcactctgactctaactcggttgtaggggccggttagggcataattactaggactacgccaatgactgtttatatcgtttcctccatgactcaatcggtgtcttacaatgcgtatgacacctctgatccgtccaatcctcgcctccagcgaaagattctgattcgcggccgcgcaggcatcgcatccgaaacttccggcttcggcgacatgatttccgacgaggcaggacgtccgatctggaccccacagggcgattgcactgccgtgagcgattcggatttcgagctgcttcaggccaataagattttcatgcgtcacatggagaagggttatctgcgagtcgtgaagaccgacatcaccagtgaccaccagcggatttccaaagagactcgcaccatggagcgcgatggattccagcctctggatgctactcgcctgcagcagaaaatcaaggtgaccacagccagcgcttcccaggaacaagagttccggatttaaccgagggtttcggtatggtgattttcgacgaacataagtttcgcacgctgtttccggagtttgctgatccagccgcttatccggacgtgcgcctgcagatgtacttcgacattgcgtgcgaattcatttctgatcgcgattcgccataccggattctcaatggtaaagccctggaagcctgtctgtatcttctgaccgcccacctcctgtcgctgtccacgatgcaagttcagggcgcggctggaggtggcgtcactgccggtgggacccagggcggtttcatcaccagcgctactgtcggcgaggtcagcgtggccaagctcgcgcccccggccaagaatggttggcagtggtggctttccgggacgccttatggtcaagagttgtgggcgctcctcagcgtcaaagcggtgggcggattctacatcggcggtcttccagagcgccgaggcttccggaaggttggagggacgttctggtgatccctggtgcgaatcttctgcgaatggccttcggggtcatcggtactcaaattgtgaaatatcgcaagtttgagcagcgagtgaagaatgatcaagctcagtacgtttccatgttcgaggagcctttcgacctggcagcgtctgttcagcgagtccgacgcgatcagtatgtccagtttaatctggagttccaacggaattacgttatgatcttcgccaactttgagatggttgacttggatcgcgatgtggccggtgaccagttcctctggaccggaagagtctttcagctggagtctcaaggctcctggttttatcaagacggctggggagtttgcctggccgtggatatcggtgcggccaagctcactgatgacgggaaaccgactttctaggtgatgtatgtttgacggcgaactgatagcgaaaatggttgtcgagctgaatgcggcgatgacatctgctcaagaggctttgcagttcccggattttgaagtcgtccagaaagctcagccgacccaacagggaacgtcaaccaggccgaccatctttttccagaaactgtttgacattcctcgcggctggcctgccaccgattggcacctggacaacacggctcgcaaatatgtagaaataactcgacagcatgtagagacgactttccagattagttcccttcattggcagaatcctgaaataactcacgtggttacggcttctgatatcgccaactatgtgagggcttatttccaagctcgatccacgattgagcgcgtaaaggaactggacttcctcattcttcgcgtgtctcaaatttccaacgaagcatttgagaacgacaatcaccagttcgaattccacccaagttttgacatggttgtaacttacaaccaatatattcgcctgtacgaaaacgcagcatattcggccgatggggtattaataggcatatgagtctgaggcgcgattcagagctaatcgccgcgcacctccagatgttaagagccatgcgcggcaggtccgtttcagccggatggtattccacggctcgatatcctgacaaggcaggcggatcggtcggaatacaagtcgcgagaatcgcacgtctcaatgagtacggcggaactatcgaccatccgggcgggaccaggtatattagggacgccattgttcggggtcggtttgttggcgttcggttcgtcagaaacgactttccgggagaaaccgaggtaactaagcctcacagaattaccatcccggctagaccgtttatgcgatatgcttggaacttgttttccgcagatcgcgccgcaatccagaaccggatagccatgaggctggccagaggacagatcactccagatcaagctcttgcccagatcggcctggcgttggaaggatacatagccagaagcatcaggaccgggccatgggtggctaactcagcatctacggtcaggagaaagggattcaacagaccgctggtcgatacggcgcacatgcttcaatcgattagcagcagagtaacataaccaggagatcatccagtgatcagtcagagccgttatatccggatcatttcgggcgtaggcgcaggcgctccggtcgcaggccgaaagctgattctgcgcgtcatgactaccaacaacgtcatcccgcccggaatcgtcatcgagttcgacaacgccaacgcagtcatgtcatacttcggcgcgcagtcggaagagtatcagcgggctgcggcttatttcaaattcatcagtaaaagcgtgaattcgccgtccagcatcagcttcgctcgctgggtaaacaccgccatcgcgccgatggttgttggtgacaatttgccgaagaccatcgccgatttcgccggcttctcagcaggggttctgaccatcatggtcggcgcggccgaacagaacatcaccgccatcgatacgtccgcagcgacttctatggacaacgtggcgtcgatcatccagaccgaaatccgcaagaacgccgacccgcagctggcccaggctaccgttacctggaatcagaacaccaaccagttcaccttggtcggcgccaccatcggcaccggcgtcctggctgtggcgaaatctgccgatccccaggacatgtccactgccctcggctggtccacctccaacgtcgtcaacgtcgccggccaggctgccgatcttcccgacgcggccgttgccaagagcaccaatgtcagcaacaacttcggttcgttcctgttcgccggtgcgccgctcgacaatgaccagatcaaggccgtgtcggcctggaacgcggctcagaacaaccagttcatctacacggtcgctacttccctggcgaacctcggcactcttttcaccttggtgaatggcaacgccgggaccgccctgaacgtgctgtcggcgactgctgccaacgacttcgtggagcagtgccccagcgagattctggccgccaccaactacgatgagccgggcgcttcgcaaaactacatgtactaccaattccctggccgcaacatcaccgtttccgacgataccgttgcgaacaccgtcgacaagagccggggcaactacatcggcgtcacccaggccaatggccagcaactcgcgttctaccagcgcggcattctgtgcggcggtccgaccgatgcggtggatatgaacgtctatgccaacgaaatctggctgaagtcggctatcgctcaagcgctcctggacctgttcctgaacgtcaatgcggttccggcgagcagcactggcgaggcgatgaccctggcggtgctgcagccggttctggacaaggcgactgccaacggcacgttcacctacggcaaggaaatcagcgccgtccagcagcagtacatcacccaagtcaccggtgatcgccgcgcctggcgtcaagtccaaaccctgggttactggatcaacatcaccttctccagctataccaacagcaacactggcttgaccgagtggaaggccaactacacgctgatctattcgaagggcgatgccatccgcttcgtcgaaggatcggacgtgatgatctaatggtttgcggcggactcgatccgccgctaccttccataaatggagtgaggaataagcaatgatcaacatttctgcgttcggctcgatctgccagttcacggcaagcagaactttcccgaacggattcaccgtcaccgagttcgccgacgatgccgatcccatcgacagcccgccgttcaccgctgccgataccggcgtcggtctcaacggtgacatggtagtttggaaccgggcgaacatcctggaagtagtcgtcaacgtcattccgaataccgagggcgagcgcaacctggcagtcctgctggatgccaaccgcaccggaaaggacaagtcgggcgctcgtgatgtcgtcggtttggtcgtggcgatgccggacggcagcaaaatcacctgcaccaacggcaccccaatcgacggcgttctgatcaacgcggtggcaagcgtcggccgtctgaagaccaagccgtatcggttccgatttgaaaaagtgatcaaagccggtactagctgatgaagaaaattccgctgacagcagtccccaatcaagcgatctcatttaatgccggtagcagctattggaagattcgcctgtaccagaacatggacatgatgaatgccgatatcagccgcgacggcgtgatcgtttgccatggggtccgctgcttcggcgggattcctcttctccaatacagccatcagtaccgacctgactatggcaatttcgtcttcgaccgcgacgccgattggacattgttcggcgacggcatcaacctgttctatctggacggcgccgaattcgccgagtatcaggcgcttgccacgaggaaagaatgagcacatcaacgatcagaaccgggacgaacaacgatatccttttggacgacaatggaaacatggttatcctcagggatgtcgaagcgtgcgcccaggacgttcgggcggcgatgctcatgcgcaccggcgaaaacattttcgatgtgaactccggtgtgggatatttcgaatacatcttctcgccgcagaaaagctatgatgacgctcgcaaatccatcgcggatgcaattttatcctcaccggatgtgaccggcatcgagcagcttgacatcgacataaccggggaagtcttcggcgtcgatgcgaaagtcatcaccatccacgggcctgttaccgcaggagtttgaaatgagtaccatccgcatccaatacgccaacggcacccaactgttcctggacggcaaaaatccgccgcccctggacccgctgccctcgtttaacccgtctgtcgaagatctggaaggcctggaccgcgaaaagaacaccgacaagggcgactcctcgccggccggtcttcccgttcccccggtaaacgtcgattccaatgtcgacaacggcggaaccatcccggctccggtatcgaccgacgctgctgcgaccgaatcggccccggaaggcgcccaggaagctcctgcagcaggccaaggcgacgagaaaggcgccgaggaagccccgactacagccccggtagaaaaggccgaggaaacggcctcgccggccgctgaagaggaaaccccggctcccgccaaggccacctctcgcaaaaccaccagcaagtaaggactcgacatgatcaacgtcagcggcttcggcacaggaattgtaatagtttccgcctcatcgttcccgatggggttttccttgtcgaagttcgctgatgatgagagtccgatatcctccaaagagctggagccgttcggatatgagatgctttatgacggtggcctattcgcctttgacaaggctgctcctctggaagtatctgtatccgtcatcgcagggagcgaggatgatattaaccttcgcatccttctcaattccaaaaagggatcattcagatttcttccgggaatcatcccggacatgacgactctcgtggccactcttcctgatggcggccgcaccgttctgtccaatgggactatcatcaagggtccggccatcgacaccatacagaacaccggacgacgcaaaggcaacacgtacacttttgttttcggtagctatcttggcgcccagactgcgcgtcaagccatttctaacgttatccaatcggtactggaggtggtctgatgttagggattttcaccagcctcctaagttcgcgatctttttcgattgtggaccaaaacacaaaccagctagttgctgcggatttgaggataagccgggtcaacacccggttttcttctgtagggcaacgccacatgctggaagatggtacgaccaagatggattccagaacgatccaccctatggaaatcatcgtcgaagtattttgcccttcaattgatgtcgtcgatcagatcaatcaattgctcctggatcgcgacacactgtacaaagtcatcactcgcggcatggtattcgaacggatgatgtgtaccagcgaagcgctcaatcagactccggatatgatatcggcgactcctgcgcggctgacattctcccaagttctcgtccagaatcccaagcctataatgttcagaaatgcaggggactcttctatgatcgaccgagggctggccctagctgaagacgtggttggctcggccggcgatctgttcgactacgcagtgaacggcgtccagaacgccgcagacttgttctgaggtgccaattgaactctttcctcaagtctattctcaacacgcctactctcaccatacgcgatgatgtcaccaaacttcctgtctggaagagtcttcaagtcaagaaagtggaaatttactcgccggcttccgtagtgtcgaaacctctggcgacgaaagaccagacggaagctcaagtgtacaccgaagctctggacattgatgtgaagaatggaaagatcatccaaccggtgcgactccgcatcaatgctatctgtccggacctgtccaccgttgaaagtatcatgaacgccttcaatgataacacctcgactttcgctatcacttctaagtcgatattggccgataaaatggccatcatggcgctcgatgtagatcagtctccagacatgttgaacgcggctgagatcaatatggaattcgagcaggttgagcctccagtattgaataaattcgattctgcgttccctcaagatagtccgacttatggggtacagattcaatctctttctgatgctaatttgctggatttgggcgccatcggcgattcgatatcttcggccgcaaaatcgctatataatcgcgtgaccagctacttctgaggatgtatcatgcttgaaatcaatcttcccgatggccgtcaaactcgcgtacaaatcgaggcgtggtcggcattggatggctgggaactccagcgccgtttcgtcgaattcgctgtcagccaagattccgacttccgccgctctttcaccatggaaatcctgggctatgcgaaagtgctgcttggcgacgatgacaccggcattccgctgaccaccgcggcagtcatcaacaaccacctcggccactggaagaacgtggaactggttttcaactctgttctcaagcacaatggcatcgacccggccacgcacgccgaccggccggactattgggaacaagtcggatcgcagatggccatcgcatttctggccgaggcgtccaagctcattggtccagcaatgaagatcgccgaaggactcgccaacaagccggagtgattcatgtctagtgatttggatgaattcatacttcggtatgaggccgatactgccagagccgagcgcaatctggagcgcctccagaaccagatcaggcgcgtgaacagcgcatcgacgagtggccttcaggatttgcgccacttcgcagacggcgcggccactgaactcggccgagtcgttccgcagatcgattctgtgacgagcgcgattcgcgggatgaacgcgcaactggcgataggcgccactggcgtggccctggtcgcggccggcgtcaaggcgttcatgaacaccagggaccagtacaatcagcagcgcatccaggcgatggacatcggcatcgccccggcacgcttggaagagtaccagagaaaattcgttcgccagtccggtggaaccatcagccgcgagcagggcgcggagatgaccaaaaatctggcagacactttccggcgagcctatcgcgatatcgggcgagtcggcccagaggcgcggattttgcgaatggccggcgtcgatgtcgggagcttccagaagggcatgcggccgctcaacgacatcattactgatctggccacgaaaatggccaagctgaagccggacgaaatttctgcctacgctgatgcccttggcgtctcgcgagactacctgagcaccctggctaagatcggcccggccatgggaaaagtcaccgagatgacgactgcggaactccagtccagggtccagggcgagtccaacattcagaaattcaacgatgctctggcgaatctcaaccagacgttcaccaccctggaaaaccgagtcggcgaaaagctcgcgcctgcgttcaccaagctgatcgaaatcatcgacaagatagtccaggctattcccaatgaagtggaaagcttcgcgaaggacaccaaatcccgttgggaagatggagtgctcgggaaggcgaccgttggcagtgatatcttatccctcctcagccccggcgccctgctcggtcgcctggcagcgtgggggactcgtcgcggcatggaagaatcagggctcatcgacaaggacaaggttcccggcgctcaaaccagcgaagacctggccaagaaacaagaagaccaggacaaggctactaagtccatgaaagagctagagaagctggctgaccagaccacgaagtctaccaatgattttgcggtggcgatcaacatgttcagtggcgcggtatcgtcgttcgcgaatgccgttgacgagcgccaagcttgggcagcctgggcgggggaaattggtcgggcggtcggtatgggaagcaccgcgccgacttcgcgggcaaccggcgtctatccgcacgcgatctatgatcagtcgaagagtggcgcggccggacaagtcttcggcgagccaatcggcgcccagtctcttcgcaatcgcatgttctcgccgcagcgcaaggccgaaccggtcaccgttccatcgtacatcaacgacatcatcaaagatgcgtcgaagatgtacaacattcctgagctggacatcaagaaactcatatacaccgaaagccgattcaacgccagggctaccagcgaagccggagcgaaaggcctcatgcagctgatgccggaaatcgccaaggcgtatggtataactgacgtatatgaccctcgccagaacatcctcggcggaacgcgtctattgcgggaaaacctggatcgagccaatggcgacatgcggctggccttgacctactatcacggcggcctcgatccgaagaactggggaccaaggactcgcgcatatccgggtttggtgatgagcgctccaatcgagctgatggaagaggcgcagcgcaagcagaaggctgcggccatgaccgccgccaacgagacgttcgctccggaaggcggcgacatggacattcgcccctatgatggcggacgattggaaactccagaccagggcaagaaggaagatgagcgccgcgaagcccgtcgatatgacgacagggttgtgcgaccggaaattcgcatcatcgaccgcatgccagaccgcagcgacggcgaaatcctcaagatgtctagacgtcaagaggccgaccgggcagattctggattccggaagttcccgaatcaagttcgcggcgagaccaagcagaacatccaggctcaactcactgcaggagccatcgcgcaagtgatcggcgttaaccccaaccagatcatgcgccgcgaaatcagccgttctgacttgctgttcggatacaaccaagccatcctgggcaagcaacaggagatcaaggccgccgcgaccgaagccaacaacgtattcctgtctccagccaagcttgccgaagccacggccaaggtgaacgccgcatcgcgagaaatggatattctcaggacatacggcgagcaacttctgaagagcgctccagagcgcggccaggagctgaccatcggtcgaatcgacatgttggtcaacgtcaccggcgcgaattctccggaagaggctcgcgagatattcagtaagcagactgcagaccagctgactacggcaatccaggacgctcaaaacgattccgcaactaagatactctactgatgaaaaagagaattctgcgagtaacattcaacatgccttatggacccgaagtcatccgcgaagatctggatgttcgggtccggattatgaaggctgcgttgcggattcagaaccgggcgacgatggaaattttcggcctcaccactcagctgcgcgagtctcttctgtcgcagttcaccgcgtggaagcaccggcaacgtcaagtgggcagggaagatgaattgatgatcaaggtgtcggtggaagccggctactctgaccaggggcgcgagcaagtttccagagtctttgtcggcgaagttgccattgtcgatatcatttctccgccaccggacattggaatccgcatccagtgctataccaggcaaatcgacaggacgaagaccattcggaatatgccgcccgccaacacgacgtttgtcaagttcgtcgagtggggcgcgaacgaaatgggattgaacttcatctgcgataccagttacaacgatcaagttctgaagaatccgggccggtctatcactgtcgcgtcggcaatcctggcgtcgattcaggatatgtacatgccggacgtggccgcgttcgtcgatgatgacatattgatcgtgaaggaccgcgataaagtcattcgtccggatgaggtgaccaacgtcaactcgtttgttggaattccatcttggtctgaatggggcgtggaattccagtgtctgtttgagccatcgattcgtgtggctggaggcgtagcggtcgaatctctcatgaatccaagtgttaatggtaactatgtaataactgctctggaatacgatttggccagtcgggatcggccgttctatatcaaagtcatggggagtccagcagcataatggccagggaaatcaaatcattcaacatgttcggagttcactatacttcgcggcaattctctgccgtcgatgggctcagcatgatgtcggaaattcagagcgtgccgccagaagaattgctcaagggtactgatgtattggcgcatccggaagaccatccggaaggcatctggcttccattgactgctgcgaacatcaatctttatgtcgttgatcgagcgaaagtaatagctcccgtacaagttcttgcacttctgtccgaagtggtaatcgactggaattttggttttctcaaagactggaccggagtcaagattccatccagatttgtcgaagatatcaaaagcgtgaagacggcacattcaccttctgtagttgcgagtttggtggcgaacggttcggcctctatgcgcgagttggaagagtattattcgactcaagatgcctttaagatgatagatatcatgacggcgaagagcgtgaacgaggccttggcgtccgaagcatcgcacaacagaatcaaaaagggataattcctaaccgggcctgggaaggctatactagacctgccaaatcagaggctttcccatgtccaatatttctctaacatccgcaaaagctcccgacaggacgcgactgatcgccgctcttgacgctcggtcgcggcgggatgctctagatttcgaagtaatgataccggctcaggttgttcaatatgaccgggccgagaatatcgcgacgattcaacctctcatcacctgggttgacacggaacacaacgccgtccaaaggcatcagctggttgatattcctgtaatttccatgggggctggcggcttccacataagtttcccgattcagcaaggtgacataggctggatttatgcggccgaccgcgacacatctcagttcctggagtcgttgtcaatgtcgaagccgaacaccggccgcatccataagttcgagcatggcctgttcatcccggacgtattccgtcgatacaccatcaattccgaagattcggccgctatggtcatacaatcgacttccggagcgaccagaatttcgattcgcggcgacaacatcaagatcactgcgccgtcgaatgtcaccgtggatactccgcaggcgaatttcactggtgatgtgactatcgctaacactctggttgtaaacggtatcaacgtgaacaaccacggccacctcgaaaacaacccgcctgatgcccggacgaagggcggcatgattgcttaaggagaatttcatggcaagttttgatttttctgatttaacagcgggggggggttgtaatggctaactacaactacatcgtcgatactggtgtgatagtcgcagataccgccgacgttctgagcgacgttgaggccgagttccgcgccgccctcggtgccaatatcaacttggccgcgagcactccgcagggatcgcttgtcgcggccgaggccatcgcccgttccagtgtcatgcggaatgaagcgcgaattgccaataccataaacccgaacgtttcattcggaacgttcctggacgcgatctgtgccttgatggggatcgagcgcggttctgacctgtcaaccttcggctatggagttcaagtcaccggccgcagccaaacccgcatttccaccgggtctagggtccagactccggccggcgcgatcttcacagtgatgagtgatgtcacgattcctgctggtggtgtcgcgaccatcgatatcaaatcgcaggagtatggcaacattcctctgccggtcgggaatctcatcatcatcgacggaacaattggctggtccggagcgaaggtcatcgcctccactcgcgtcgatccgggcagccgccaaatgagcgatgcagagttgaagaatgcccgcgttaatcgattggccatccaaggccgcaactcgactatggccatcaaggcgtatgtgagcgccgttccaaacgtcacgtcggtgaacgtaatcgagaacaacaccggcgccgttcaagtggtgaatggagtctcgtttacccttccgtatgctgtttgggtctgcgtcgccggaaacccggataaacaagcagtcgccgatgcgttgtgggccgcccataacggcggaactccatgggactatggtgcgacgaacaacggcgtcccggtggacggtccgaatggcgttcctgtgcgcgatccggcgtccggtcgaaagtatgtcgtgaagtggaccactccaattatgtacgatggatatgttaacgtaacagtccagcaaggttcctcctctgtagctccggaagccattcagaacgcagtggtcaattacgcccaggggaaagtggaaggggaagaggggctggtggtgggcgcgagcctgtcggcattcgaagttgccggcgccatcgctcgcgaaattcccggcatctacatcaaactctgccaggtcgcgtgcgtcgcggctggctcgccggctccggctccgggcgatttcacttcggaatacgtcatgagcgcattcggccaggctaccatttccgttggtaacgttcgggtgactttcgtatgactctgcctgcgtacaattcggacatccaacaagctctgaaatggctccataaccaggcgcctggaatcaccggcctgatccagagaaaggcgcaatggtatgacagattcagccgccaattctgggccaactgggagcgcgacgttttccacttgaaaactgccaacccgttcggccttatggtttggtgcatcatcctcggcacgccttcgaaagggttcggcctttatccaaagaacagttcttgggcattcggtcggctacgccagaacttcatttatagcggtacacaagtcccgccaccggcagacgcatcgcctggaggcaacttctacggtggcggcaatgccgaaattctcaacttggacgaaatcaggaaagtgcttcagctaagatatgtagcgctgatttcgaacggctcgattgcatatatcaatcgcatgcttcgttacatattcaatgatgatgagccatgggacgaggcgaccggtctgtacttctatctcatggactcaaccggcgagaatggccctgtggagaacttggcagtatatcggaaagattgggaaggtatggtgttgttgtccagttcgcccagaacgaaccacgtgctgacatcgacccctgccagcgacgccgattggccaggagtcgatccggccgcgagcggtcttccggtaacggtcgaaacggcgtccgctacggccccggacggctccgctacggtgtgcaagcttactaagccggccgggagtaccgcttacgtctccgcgccgatagatgggccgctggggtccggtagcactgtaacgttctcgttcttcgcgaaagccggctccacccgtttcattgcaattcagtcggctgccgatttccccagtcgagccgatgccgttttcgacctggattccgggaacgtgatcagcgatcagatgttggacagcagcgtggtaagcgcccgaatgattcgtctggagaatggctggtggcgttgcgttctcacgaccaagaccgtcagctcttcgttccgcgcggcttacatcgctccggcagaaaccaacttcagctggattgattcgaattccagcgcggcgattgatgtgcttatctggggcactcagatcgaactgggtgatactccaaccggatacttggagactaccggaacgcccgtaaccatcaccgattacgttctgcagagcgcccagaccggaacggtcaagttcacacagcctcttccgaccggagtagaagcgtattggactggagactggaaaggtgggtctgcgaccgagccggccagattcgcagtaggggatgggactcaagatacattcaatctgtccagccctgcatacatcggcctacccactagtggggcgttcaagctagaatacagagttggtccggcgcttaatttgtcgccgcaattgatcaacctcatgaatgaccgggcggtcggcatcatgccgacttgcgccggttgcgatgtaaaagtcattcaggagtaatgacgtgatcacacccgaactgatacccagtccgtttgccgctcagggcgataaagacccgattccacaaacctcctccactggcttcgcaaaccttcgcgacggctatacgccggactacgaaatcagcctggcgtcgaacaacccgcaggccaaagcggtcgagcggaaaattcaaaaccaactcttcttcatcgcgacccagaacgcacaggcgtggcagcgacaaatggcgccgccgtggtttcagggcatgcctggcggctacgaacagaatgcagaagtcgtgcgcgtcggaaatgacggcataatgcggcgttatcgttccatggtgaatgccaatgcgagcgaccctctcagcagcacgacttgggaagaacaacccgcatggtcggcgatgcgctccaacatcccgatgccggccggaggcccaggcctatcttctggcggagaagtcatcacgaccggccgcaacttcaacgacctgttaaatgggacgtgggagttcttctctgattcagtggttatcgcttctcagaatgcccccgtatatccggcttccgctggtgccgctgctggcatgttggaggcgaaatcttgggtgtccggagccaatacgttctgcgtccaacgctacactgatcgcgtcgggaacgtcgctgtgcgcgggcttaatgccggagcgtggaccaactggatgtatgcggtaaacgtcatggcccttcaacaaggtcgggtcacctatggagtcgcggccggatcggcgaacgcttacacgttgacgctagttccgcagctccaaggcggcctggtggatggcatgattcttcgggtcaagttcaacaccatgaacaccggcgcctccaccatcaacgtctccggactcggcgccaaagccatcgtcggcgcggccaacttccctctcaccggcggcgaacttggccaaggactcatcgctgagcttgtcttcgacgcagcaggcgaccgctggagaatcctcgcaggcgcgccacgcatccaagttggcaacgccgatcaagattaccaggcccccagctggaaacaggtgaaggattacgtcgcgtcccaaaagctgactgaagtggactgggctgacgtcgtcaacaagccgaacgtcgctatccaagacactacgccgtggttcgccaatctggagttgtctgacgctcggcctttcatcgatttccacttcaacaacaaccgcgccaaagacttcgactatcgctttatctctgaagctgatgggtcgatggcgttctactctcgccaggggtcagctggtcctacccaggatatcctgttcagcaggtcgaatgttacattcctccagccgcgactggatgttgcgaaaaacctcgcgtacatcgcgaactctggtcccctttggcagaacacaactgccgatcagcctggttggaaattcaccttcgcacaaggtgtggacgccaacaacaacgcggttatcgcagtcaataccaccaatccggacggctcctatcgctcacagatcatgcgatgggactgggcgtccacgaacgtcatattcaacaatcgtccgctctttgccggtcaatacactccttgggattctggaaactttaatccgaacaccaagttgactgtgaatgtcacgaaccaaatcgccggcccgaccgggattcggaatacaaacggcaacaccggcaacatgaacacatggggctccagttccacgacggcttcatacggaaacgctgctcttcaaatcttcgggaaaggtggtggcgagcctgccgcgctttatttcgacaactcccagacaggatggtatctggggatggacaaggatggacagctcaagcgggccggctggtcgctcggcaataacgcctacgtgattaccgacgaatccaacattcgtttccacgtgaattccatggctggcactcctgtttggggcggaaacgaattctgggggccgtggaactttaatccgaacaccaagctgaccatcaaagccggcacccaggaaactagcagcactgcgatattcagcggaactatgccattcgctccaatcgcatcgctgtccgattattctcaggcccctttgacggtttacaacgcgccaaccggtccgtctgcaaaaccggccgtcatcgcgttcattcgtcctggcaactggggcgcgttcttcggcatcgataccgacaacaagctgaaatggggcggcggatcgctcggcaacagttccagggaaatcgccgattccagcaacatcatgaatctttgggcggccaacccgaccgcgccgtcctggaacggccaaaccgtttggcgatccggaaactttgatccggcgacgaaagtggatttgaacgccgcgaacgccaccaacggcaacatgatcttcaaccgcatcgccggaactggtagcggcatagcttcgtccggccgagttggcgccatcaacctgcagaacggggcgcattcggggcaagcggccgcagtcactttcgagcgtggtggaagtatcttcgtcaacttcggcctggataccgacaacgttctcaaagtaggtggcggaaacctgggggcaaatgcctatccggtcatccacgccgggaactacaataactacatcaaccaggcgctggttcaggtcggtctgggcggggtcggttcctatggcattttcgctgttctggataatgcctctccggttgcaactgttcaacccggagtggtcgtggacggttccattctcatctactcgtcttgcgccgcaaactacaatagcggtcgaaggcctgccggaacttggcgctgcatgggatatgtagtcaaccgggatgccaacactcctgactccgcgacccttttccagcgagtgacgtaaaatgaaatggacgcggatcagaaaccctcgttggctggatgaaacaaacatccacgccatggtgactttcgatgggatcggggaagttcctttcaccgccaatccgcacgacgtggaggcccacggaagggccatccacgctgcaatcctatccggggcgcacggacctatcgccccggtcgatgcgaagcgggagcaggccttgcaggacgctatacgggccagggaaaagcgggctatccttcgtgatacccgctggcccatagatcgtcacgacgagcagaggcggctgggtatcgaaaccacggacggacctgggttgatagcagcccttgttcactggaggcagcagattcgcgattggaatagcggggatcggccgcgacttcccatggctttgaaaacaatgttcaaaaatcaggagtactgatgaaaatcacgaaggatgttctgatcaccggaaccggttgcaccacggatcgggcgatcaagtggctggatgatgtacaggcggccatggacaagttccacatcgagtcaccgcgagccatcgcggcctacctcgccaacatcggcgtcgagtccggcggactggtaagtctggtggagaatctcaactacagcgcccaaggattggccaacacctggccgcgccggtacgcagtagacccgcgagtccgcccgtatgtccctaatgctctggcgaaccgacttgcccgtaacccggttgccatcgccaacaacgtgtacgcggatcgtatgggtaatggctgtgagcaggatggcgacggttggaagtatcgcgggcgcggcctgatccagctgaccggaaagtcgaactattcactgttcgccgaagactccggtatggacgttctggagaagccggagctgctggaaactccggccggcgcgtcgatgtcttcggcctggttcttctggcgcaatcgctgcatccccatggcggaatccaacaacttctccatggtcgtgaaaaccatcaacggcgccgcgccgaacgatgcgaaccatggccagctccggatcaaccgttatgtgaagaccatcgccgcgatcaatcaaggctcctgatattcgcccaaaagaaaaggccgcttattcagcggcctttttgctttccggctttgcctcttcaaccatcttgacttcaaccggcgcggcggactcttcctgagtgaccgaatccacatagttccctagtgaactcagaacgccgattaacagcgctcttaccaccttgtccttgactgtctcgcctatgatcttggtcagaacggatattaactcttcccggagtctggggctgattcttggccgaaagcgcttgcgatgctctttgcgtttcatgtttagtcctctgtctgcggtcttctcctcaccccgataatggcttggggatgcgctgtgttaatcggaaggttcgggcgctattataactcgtcgaaaatgctcgcgcttaactgtttaacgatacgcaccgcgatattaaatcgccttctttctggccaaggaactctggcggccgggtccggtctaaggcctaatttgtcgacattaaaacgagaaaacccggatcgcctgtagggcaaggcgtccgggtttatttctatctagtgtacgctaggatcagtgacttccgccccacccgtccagccagcaatcgaagacggcgtgcctcggcttgtccttggcgccatgggagaagtgcttgaaccggatgacctggcccttgagatactccctgtcattccagcggcgctgtttctcgtcgtgggtcaggctggaggccgacacgttgaaggtgactccaggccacagacgttcgttgcggcagacgaacgcaccgaccattccggacggcgacaggttttctgcgtggctggagcgggccgtgtggccaagttcattgatgaaagcttcattgttgttgtgcatcaactcttccacgtcgatgatctcagcttcatcgtagtcgtatcgcttgactttcacacagtgcccttccttggcagtcgagcgaccgaacttgtacagtccatcagcgcgcttgcccatggaaccttcgaatcccagcattgtgtggcggcgctcgacttcgctgaactgttcgatggaagtcaccagttcctgctcgaccaggtgaatcctctcatagccgaggcagtgacgaaggaagttcacgcgctcggccgccctggctaggcgatcttcggtcggtgcgcgaggatcggtgaaatcatcgaacacatggaaagaccagtccggctcaccgctgtggcggcgaagatcgccggacgacttctggaaaactttcgggtcgctgatgtcgccgcagaccagctcgccgtccaggccgttgaacagtttatcgctgaggtattcgtagatcgattgattgttctgccgcttgagttgacgagtcagcgcctcgccttcgaatacgaagcagcgaaatccatcgatcttcggcgagaaatacatcggcagttggccttccagcagcttcgggtcaaaattcgatgcgagcatgggtttcatacagttctccagaaaagaagcccggcgaaccgggctaaatggcggtaagccggctcagatggtttcgttggcatagttcagttcggccatgatcgacgcatagcgctcgtccgactccttaatgaaaacgccgtcgtacatgacgcctttgcgatccttgatggtgtcgtaggctgcagcgtagcagtcgagcatggtggtgtcgtgctcttccgtcacgtcgaacagagtcatggcggccgataccaggctcttgatggccaacccatgatttccacgtgccagagcgcctgccagatcgccgaggcgctgcaaatcgtcgccgtaggtgggatgtacttcgccgctctcgatgaaggccgacagatgatcgaacagattttcgccgagttgcgcggccatgatcgtggcaaccaccattacgtcgccgatgccatctttcacatcgaccgggttgttctgaacccaggcttcgcatacttctgcgaactcttcgaccaacttcaggaattgatctttcgcagacgagcctttgatcaggttacggtcggaagcccatttaaccaccaggtcgtgaagttcgcggctcatgatttgttcgatgttcattctttcgattccttctgtatttgggatttgactgcattgatgatggacgccgtgctctggcgcgatccatccttggtggtaccgaagtagaaggccattaccgacttcagctcggcgaaccaatagccgatgatggtgccgatggcgaccgaggatgtcgggtccatcagagcctcgcggccgaatgtgaagattgcgatgatgatgagaatggagcctgtcagaagagcgaatgtaatcgccgggcgaacgaaatcgttctgctgcgcagcaagcctcctcgccgaatccctgtctgccgcctctgcggcgaactggctaagctcggcctggagctggttctgctcagactgaaggcgattttgttcggcttgaatcgcaagctcctggagacgaacgcgctcggcgctctggagttcggcgagacgcgctagagcttccggattcgcgtctagagcgctagcgaccgaggctgggtcggccttcgaccccagcgccgtcgcgacgatagcgccaacggcggcgcctgcaggcccacccaggagcgaccccagagccggggcagccgcgccgatcttactacctatgtctttccagtccatttcgactcctcaaaagaaaggcgccattacagcgcctttctccggccggtgatttagaactcttcggcttcggtcgcatcgccgacgccaccggcgtcactgcgaggctgttcctgcttgctgtagtccaccttcacctcgccgcctacgaacgacttgtacaggtcggccgcagccttgaagtgatccgggttcttcaccaggccttccagctcgaactggacgccggaccagctgcccttgtcgttcgacatgcctacggtggtcatacggaccaggttggcgaaagtcggcggggtgcgcaggccctgcggggtctgaacctttttctgggacagcgcggtcatgagcttcttcgaggccttgatctgcgaagacgacagggagatcagagcctggccgaaatcgccggtgtccggatcgatgacgatgacgtaatgaccacgggtgtcggcgaagtagtcagacttcttgtcgctgaccgaaccgtcttcgttcggcgcgtacaggcgtccttcgacttccttcaccttggccgggtctttcatcatttccttgaagtcttcgacgctgatggcacccttgaaaccgccctcggcctcgcgaccggcccagcggatgaactcgcggcggtacgcggccggaatgatcagcaggccggtcttgccgtcgtaaaccttgccggtgacggtgttcaggaacatgccggccttcgcgccttcgatgtacttcgggtcatcttcatcgacctggggagacatcttctgcaaaacctggatgaaggggatggcataggactcggcatcggcgccttcgaagcctgcgccgtcatacgatcccaaatccatgaagtcgggaacttctgtagtcgcgacggcgccgccaccggtggcaattgctacggccttggtttcttcggttgcttcggaagtttcggttttcttaccagccatgttaggctccttgtttgtcgaatttcagttatcgctaactgtgggtttataataacggaagttgcaactaagtaaagcaaattacatatcaagatttgctctttttcaccttcggtttcgtgatcttggcctctttgtattcgtgtacgccgatgaaatctggcagctcttcgcccttctccaggtactcgcgaccgaacgcctggagggtctggtaatggacatcgcggttgatggtggcgtcatagccggcttcgatgatggcctcggccgccttcttcgcatcttccatttcgccgcgaccgaattcggccagaaccttggtcttgatgatgccgtcgttgtcggtgtcttccagccacttccagaacttcgatttgttctcttccttgacggaaatgatggccttcggctctacttttacagtgcgaccgtccgccagagtagtggtcttctgaccaagctcctccaacagctccggaatggtgttacgcttgagggtcttcagctcctcttccttttcggccagcgccttttgaagatcgaggatttcgccgtccagctgcgaagccttgtccaccaagttcagcagtcgatggccgatgtcggtggcttccaccgccatttcatccatgacgccaaaatagtcgatttcgcccggcgcgttctctttcaagtattccgggatttcaagctcttgctctttcatgtccgcctccaacttagtgatgttcccttacttgaaccaagtattgagtagatattatgccgcatcttccttgatacggctactgatttacatattaaatttcgtcgcgagtgctaacgtcagcctcaaacacgccatcaacgacataacttgccaggttgcgtttccactccaagctgacctggattttctcgtcgatggaatccagacagatcaggtcgaagtacagaaccgagttgacggtgccgattcgatgatttcggtcttcggactgcatccgcagctcgttgtcttcgtcggtcgtgtagtagatggccacgtctgcggctgtgagcgtgatcccgatccctgctgcggccgggttgcccaggaacacctggacgcgcttggcctggaaatcgtcgatcaatttttcccgctcggcctctttggtctcgccgtagtaggtgccaaacgaaatcccttgggcctccaaatacgccttgatctggtcgatttcctgaatgcgcatggcccagacgatgatggaacgctccgggtcttcctccagcagaccctccagaagatcagtaaacacggcgaatcgcgggttgtcttcgggcggcaggatcaccggctcaccatagacgttgatatagccggacgccacttgcttgagcttcgagcgcgctgccgcagcatcgaaagatacatccagcatgaaatcttcgttctggagaacgaagtgatagtcttcttccacgcgctgataaacctttcgttgctccggcgacatttcgaagtatatgcgcttgtacaccttgtccggcaggaatggcaatgcttccttcttcgtgacccggaagctgtgcggctcgatcagggatcgcagcttgtccaggttccggaataccgggcgcccataatcgtctttttcgacgagttgcggcggcatggtttgcttcccttccagcttgcgcatgatagcgatcattcgaggatcgtcactgggcaccaagacggaaaattcggccacaaacgcccgataggatttagtccccagaattccattccgcaagaattggaactgcatgaacaaatcggtcggcgcccgcgtcagaggagttccggaaaggatgcgacgggccacggccttctcgcccagctttacgatctttttcgcacgcttggcttgtgggtttttgatcctcgttgactcgtccacaattgcgcaaactttgaatgtatcaaggaatcgctcgacctcatcatagccagcctggtggttgattgcgtcaacgttgatggcgaagacgcgaagaactttttcatctgcgaacgtctcggaatacagacggtccaagcgcgccctggcctttttggaagtcggtcggccgcgccaatccacgctcaaagtcttgatcgcgacgtgggtgggaatctcgcgcagaatccagttggtgtggacgcctttgggggcgacgatgagcagcgcgtccacgcgcccctgtaggaagaggcgaacggcatcggccaaagtcgtccaagtcttcccggtgccctgctccatcaggtatgcgaagttccgtttgttcagggacgctgccagggcattgaattggtgctgcatggcctcggtcttcatgcccttgacgggatatgttttggctttcatttgttctccaaatcggcgaggaactgaacaatgttatccagtccttctgcatagctcgcaacttccaccaagtcgcggctgttaagctcgaacaaatcgaacataggattcagcagcagccaatcggttccgatcttggccaggacgaagccccggccaccccagccgatccgctcccgaagaaaagggatttgcccaggttcgaaacatctggccattgggcaggtggaagcgcgtttcggccactcctccaaagccttgaactcgacccagaactggacacctcgacgattcaggcagatcgaatcggacatgccagaccgccgcgtctccagaaagtcgatcaggattcggccgagcgagcgctgcttaaacgcattcgccgctttcgtttcgcgatcattcatcaccttcgccctctttggaaactttctctgcttgtgctgccaactttgacttctcgcgctcggtcaatatccgcttgacggccttcacgatgaacatgtcgatgccgctgagcctccatcctttgatcaggaaccaagcgccggtcggcgtcccttcagcaatctgctttccgtattgcagatatttttcaggccgaattctgaaacgtatcggctgatcaaccgagtcatcaacgcacatgatgtcgagaaactgcgactggcccttgtacaccgggtttttcccttgatcagccctcttcttctggcgaatcggttcgttctcatcagacagaacttttttcaccatcttgacaatgaccagaccatcatctccatcgcggatatcccgaatgttctgaatggggtttccggaagttactccaaccagctccggattgtcataagcatgaccccagagcgtgtgagcttcgttcaaatctgcgaattgaacttcagaattcgacagactcgcggcgactttctcccaatcctgaagcgtcttcaggtgggtgcctgccagctctttatattgagccttcagctccttaagatcggccttcaactccttcagatcggccttcaacagtttctccagttctttgtcttggctgattttcgccgaaagaatctgggcttccagagctgctacatcagcagccttgtcctcaacatcctgtgccgatatcgggcaattggccagggcgatcctcgcggccttgacttcctcacgaagacgcaggaaccgctcggccttcgccgggccgaagcctttggcgttcatgatgccgccgatcaggcgcccgtccgccaccacccagttgagttcggaatgctccgggtccagggccgtatattctacgccttctttggccaattcgcgaaggatagacacagtttgctggtcgtccttcgccgcccgaaggcacgcggccgcgtattccaggcgatgataccgcttcatgtagcaagtccagtatgtcaccacggcatagcttaccgagtgggagcggttgaatccccaggcgccgaatgtcaccatttcctgccaaactcggtgagcgtcttccggggcgacgcctatggtcttggcgccctcgatgaacaattcccggcgcttgttgaaaaattcttcgccctttcgcgccgacatcgctttccggatcgccgacgtttgttcccagtcgaactgaccaatgtccttaacaattgacatgatctgttcttggtacaggaacacgccatacgtccccgacaaatactgctcgacctgcggaatggtataggtcacaggctcgcggccggccacgcgctcgatatacttggttgccataccagaagacaacggacccggacgggcgagcgccgtgatgtggtcgatgttctcgaacgcggtgatgttgatcgcgtttgctaccgagcgaacggcctgcccttcgaactggaagatgccggacattttgtcttcattgagaatgtccagaaccgccttgtcgttcaaaggcaagtcgtacaactcttgcgcggtcacgcagttcgcgtcctggatgactcccaaagttcgaaggccgagcgcatcaattttgagaagattcagatattccgaatcgggcttgtcgagctgcgcgacgccttcagaagttaccgtacagaagttgatgacttcatcgttgcagaccaggatgcctgccgcgtggacgccagagtgggatgggtgaatttcgaggtcgcccatgcaggcggacgcgatctcatacttttcgcggaagtcgcggccgggctgagttttttcgaaagtgtcctccaatccttttccatatcgttcgtccgccgatgtatattcgatgatcgagtttttgatgttgtcggtgtcgtggaatggaatgccgaagcgttttccgacgtgagcgataaccgacgcggccttgagtgtgttgatgttacccaacttcacaacgttccaagtgccatacttctgctggagatattcgaacactagatagcgatgggtatcggcgaagtcgatatctatatcgggaagatcggaccgggaaatgtcgataaagcgctgaaagaggaggcgatgcgggagcgggtcaacctctgtaatgccaaggagatagcagaccaaagagccggccgaagagccgcgagctggaccgaccagcatgtgcttcttggcaaacgcgaccagatctgccacgaccaggaagtagctgtcgaaatctttcagctgaatctgcttgatctcttcttggaatcgatcctcatactcctgggtccattccttgatgtggccgcgactgaggcggtaggcttgcccctcgcgagccagagcgacgatatcaccatccaagtggatcatcggcgccttcgccagtttcacatccgccaaccgctcgactaccgcacgagtattggctgcggcagtatcgaactcttcgcgagtcatgatgtggcgtaaacggctccacagctcctcttcggtggcgatgtggcgaaggccgaccgattcccgcaccttccaggccgacgcgaaatcagcatggtcgatggatggcatgtcgttgtaagaggtaattaccaccggctttccgaatgccctggccgtctccatagcgccgtgcgcggcgaccatcgacgcgggattgatgtcaatgtagtcgattccggccagatccagatgggcataggcctcgccagcgaatttgatgacgccgtcagcttcctggaattcttgcggagtcaatccttgattctggaccgacttggaagtcaagcggtagaacttcttggtgtccttggcgagcacccaggctttgagcttcagctctttctcgccatcgtcggcgcatttgatcgggatttccatgccgaatccgcgaggcagttctgccttggcagcggcttgttcccaacggacgtggccccatgttccatcatcgacgatggcgacgaatggggattcgatctctttggcgcgctcgatgatctccgggaatcgaccatatgcggcgccgtaggagtaaccagagcgaacgcggagctgagggaaagacatcatgcggcctccattgcttgatacgcccgatacactcccatgcgcttgcagacttcgtggagcagccgcacgtcgtcgagcgcccggtgtttctgtacatatgggccgcagtagtgctcataaagatgttgcaaccgcatgcggtggccgaacaacggcgccgactcttccacagtacagatatcgagtgatgggaaattgacttcttccaggccgagctttccgcgagccaaatcgcaggtaagcatgaacttatcgaatggcaggttgtgggcaatattcgcgtcggctctggaaaagaagtcgcgaactttctggcgctgatcgaggaaagatgggtgcttgaccaggtcttcgttcttcaacccggtgatcttggtgatgatttcctcgataacgattccaggattgcagatgaactctacttcatccaaaatcttttcgccatcagttatcacgccggcgaattcgatgattctcggctgctttctcagactcaccctttggtggaacgggagccctgtggtctcagtatcccatacagcgaatatcatgtttgttccctcttatgtcgaaaggccggctgctttcgcgaccggcctgaggagtataccgcgacggctgaagatttacgccttctgtccgtctttcggcgtgatgcggccggagcgcatggtggcgtgaacaaacgccgaatagttgatcgagtccaaggccgaatcggcatccttgaacccgctattcgccaggcgagtgagtttacccaccatgtgcatcacgaacatggcgagtcgatgatcatcggcggtcttcgccaccaggccgttcgggaagaggatttccatgatctttccgtacatcaggtcattgcgaccataggtgctctggcgggcgcggaagacttctgctgcggcgtacagattgttgagaacatcttccgcgaaatcatctggatgggaatcatcttcgcccggccagacggattccatggcgaacggcgcggcgtcttcggtcgggttttcggactgagccgtttcagcgagcggagacggggctttcgcaaacgcctcgtcgagggtaggggcggagttcggggcggccgggaacggctcgcctgcaatgtcgttgggcgcgctatcggggtcgctatcggccgcgacggcgaagaacggcgcatcgcaaccttccaggttcaggatgtaggagtcgatccccaggctattgtaggcatcgatgatgtcctggcgatcatcgaacgccgcgacgatcttggtgacgccttcgattttcttcaggatgtcgagcgcgactgcccgcttgaactgaggcgccggctcggtgttaccatacggccgcatgatgagttcatactcgcgatgttcggcgatgccgagttcgcggtggagcttggccctggtctggaaaaagtggttgtcggttcggccggtgacgaagaaaatcatgaggtcggcgtcgatggcattcctgatgcgacctacagcgtgcgggttgagagtgtccttgtcgagacgagaatgatactcgtcccattgccgttccaaggcgaagctcttgcggtggctatcgtcgaatacgcagccgtccaggtcgaagatgatgatgccattcttgggtttgcgttccatattcagatttccttgatggttgctttctgggtgacggttttatcgatgaacgtcccatcagaagtgagtcggaaaacttcgcagttctgagtgaaatcgaacgattgcacgttcatcgtgatgcgaatggattcgctgccgttggtcacttcgacttgtgcgatgtcgccaactttctcgacaatgatcttcatgttacatggacttcccgttgacggccacagggttggcctcttgtttttccgatccccagaaatcgcggcgcagttcttcctgctcggccgagcgatccatccaggggcgatagaacttgcactggtagataggttccaacggaacatcaaccacaggaatctggccgggcttcgtctccagagcggccatgaaccggtcataggatttctgctggatttcctcttcattcatcaccttcgacccatagcgcgggaaggcgcaggagccggtggcgacgcagtgcggctggagtaggctgtcgaacatcggatagacttccagaaccagccggcgcatctcgcggaacacttcctggtattcgccctgggtccgaacgcacaggcgaaccttcgccatgtcgctgagagtccgcagattgaacttggccgcgatcttcgtttccatgttggaagggatgatggcacgagcgtcctggagcgacgcgccggcctccagcagcttctggtagctggtttgcgcgtcggcaatggcgtcatgccacagacggttcagctcttcgcggacatggtaggtcgggtcaggctcgccatttaccgtagccggttcgtcgaattcccagcggaaagcttctggctgaacgacggcgctgatttccagagcgcgactggtttcctgctggtaagccccggtccgcgtccgaacgagttgatgggtgaagttcttgctcacgccctcgatctggaaaatgaagtctacgaactcgaacggcgagcggatggtgtccagcatgtacttccagtggtcgagcttttcggcctcggtcatggtcgccgggtcttggccgcgcatgcgggtggacttcgtgcccaagagcaattcccaggcgttctgggtgtaactaatcagagaaatcttcatcagaaatcttccggaattggcgtgaagtggaatttttcggtgagagccagggccaggccttgggcttgctccctgttaaggccatactgctctatctcttccttgagcagttcgcaggcctccaggcgcgcctcatactcttcagcctcatggacggatgagaagacggctccatcagaggttcggtacacaagttcgatcgccatggtgacctcagtagcagcggatgatttcggcgcggatatctcgacggtcgaggtagtgctcacgaatcttatcgcgggcgcgctcggcctcttcgcggctgccgaatgacaggttgaacgacgtgaaaggcttatcgtccagttcagcgccggtctgatacaggatgcctaccagaacgaaagacggcgcggtcttcggctgctggtcggcttgcatttcgaggaaggacataggaacctcttcagaatgatctggtgcgtaaattaatagcgctcctgctgagcagctacggtttccggctcgtagatgagcatgtcaacgatttccgggcactggcctttcacccagtcgatggccgcgaccagtgtggtggaagcggagaaagagaaagtgcggtaagactcatggatgtacggcgaccccatggaatcgcgctcggtcgtgcgcgaaatgactgctttgatattaacgatccggcccatcttcggcctccactttagcgattatatcggacaggcttaacttctcgccattcaggaaataactggcgcgaaacttcctgtcgccctctggcccgacgattcgggccgttatggtgagactcccgccgccaagggcatcggtgtcccggaagaaagctagcagcgcccgcttgagcgctgcttcgcgaggatcgacggccattaacctaccacgttccagccgtgctgagcgcaccacacggcaccggcccctgcaggaagactattcagaaggaacacaggagtcaggcggccgtcctcggtcatatggatgaagtagcgggcgccttcaccgagccattcggccttggcgatagcgcgttcgagattggccttggtggcgtaggttttggtgtggttcttgtcggtggagaaggttacttcgcgggccatttgtcgattccttttggttgaagggtttcgcgtttcgatgagggaatattacgcccacctgatccagaagtaaagcacttttgtaaattacttcacgaacatcttcttggccttctgataagacgaagaagtcatcaggcgctcgatgacgtccatgtcagaaaccagatcatccagaaggacattgcgccaggtagcgaaccggccgagcgagaagatgccagcctcatgggtgagattccagatcatggattcgcgctcgtcgcgaccgagcggaatgattttgcctttggtctggatggtcggctcgccatcttcgatgagatgccttttcctgatgccgaaggccgcgcaaacgtaatccatatcccagtcgctgtcccattcgatggtttcgattttaccatctaaagtctccactatccccttagtgatggattcgacgatcagagtatcaccggtgatggacgctcgaaacgttcccactttaggaccagggaaatacacggtctggaagacatcacaggggatggaaagcttgtatcgactcacgatgatggaggttccttcaccgaatgacgggtcgattcccaggtccagccctgccgcagccagattggcgcggaacggcgcggtgctgatgatattcacgtggtcatcttgccggcgaagatactggaagaaagaggcgtcgaaaggacggctccaagtgatacgattcgcaagcttagccaccagctgctcatagtagtcggccggtgcgatccaacgcttttcagtcgccagattccagatggaccggtccgacaggccgcccgttactttcctggagtacatgttgcagtggtcgatgcgcggctgggaaatgaactcgccgtcgatgtagatagctttgtgtacagtgacttcgcggaacgggatgccggtgagttggccaatcactggcgagcggaatcgcagaagtgcgttgtggcgctccttattctccggcgtcgccgcgtcgatgatttgggcttgaggaaagcgatgcgcggcgatcagtccggcgagtccggcgcccacgatgataactttctgatcaggaatcatgatgtgtcccttatgagtgtacaaaacttgagaggataaaaaagggacccattctcatgagtcccttgaagagctagacgattcaggctcagaagagcggcggcttactcttcatcaccttcggaaccatcggcgccctgatcttcaccgtcgtgctcctggccttcgtcatcggccttctcgtcatcgccctggccagcttcgtcttccttcgaagcgatggcaaccagatcgacccagcccatgatttccagcttgctcaggtagctgcggaccgaagtgccatagagcagatgggccaccttctcgccgaaggcttcgatttcgaccggctcaccaacggtgcagtgctcgttgatgtaagcgaacaccttgccgcgagtcgagaaggcctgcggagtgccatggccgtcgccggtcgggatgaagtgggtggcgcgggggcgacgcgagccattggacttcaggtcttcgcggcgggcttcggccttcttacggcgctcttcctgctcttccttgcggcgctgcttctcggcttcgcgctcggccttcttctgctcggccaggcgcttgcgctcttcttcgcgagcgactttctgggcttcctgggcggccttcttctcttcggcctttttggcgcgctcggcttccttctcggccttcttctgctcgcgctcggcttccttggccttcgccttctcggcctgctcggcttccttcaacttggccttttcagcacgctcggcttccttggcggcggccttttccttcgccttttcagcacgctcggcttccttcttctcacgctcggccttgcgcttctcttcgcgctcggctttcttctgctcgcgctcggcttccttggccttcgccttctcggcgcgctcgcgctctttacgttgacgctcagcggccttctctgccttgcgcagggcggctgcttgttccttggtcagctcttcgccttgggcctggtcgttctggtctttctgttccatgttcttactccgggaatgtttaaagggatggcttattggcctgtgaggggattatctctaaactaattgaagaagggaataccttagcctgaactttcctaaatattttctttcgggaaaatccagactccagggaacttatttatgttcgcgaagtttcaactcttccgcaaaaacagcaagtattcaactgcacgagttatgccggtatacatcaactgactataaggaattgacggcaagttttcttccagcattgccacacgcttccattccgatccctgcgacttatggaacgtcatcgcccaaccgaagtcgaatccgccaatggccttctgcgcctccagccgcacatcttcctcggccgaaaagctcaaaggattgaacttcacccatcgctcatagttcgttccgataatgcgaactttggcgaacaacatttcatccggctcgtcatcatcttcttggccttcggggaccggcttgaagtccagcagaattgcttgctcgccgttcatgatgccatattcgtgctggttcccggtgcacaccagcttctcgccgatttccggttgtacacccttgtagccgaggatgcggcgcgccctggcgttcaaacggcgacgagtattgttgtaggcgcaaaggatcacgccgtcatcgtccaagaacgtccgcatttcgtcgtccgacatgtcgaatccggcccgtaccagaatgtcgtcatactcgcggcagggcaggcgcttgccctggcggacgaacatcgacgcccgaacgatattgccggcgttgcgctcgatttcggtcatgatggtgtcacagctgttctcatggaaaatctggacgccgcgcacaggaggaacttggccaaagtcgccaatttccagaaccggaattcggtgcgacagcaagcgctcttcatcccactcgccgatcatggacgactcgtcgagcacgaccaacttcggcttctcgtcgagcgagtctttgttggcaaacatgatttcgccgtcttcatcttcgccaatcggccgatagatgaagctgtggagggtccgggcattggtgcagcccttctcgcgaagccgcgctgctgctttcccggttggcgcgacgaagaccgtccagtccatcgagcagcaaagttcggcgatgatcttcgcgatggaagtcttaccagttccggcgaaaccagcgagtcgatagacctggcggcggtgcgctcgatcacaccaaccgcgataccagtccacaacggaattgatcgcgtcgatctgctgactgtttggtcgaaagccgaatcgctcttcgatctgatcgacggtgaagttagatgctgacatatttgcgttctccaacgctaggtttaattgaatcgaggctcagtttaagcacgccgtccacagaccagccagtatcacgacgatacttgcggccttgcgggtcgacatagaagttcttcgtgcgccgcagcagaacataatgccaagcagctccaagcgcgtggacccttcctttatacgggaaagccttcgcctgctctgcggcctctttggccccagggagccagcggacggtagaaaggaccaggaccgcacccttaatagcctgggaagcggcgcggccgtcctgtgggctatagcgatgtctatcgaagtctacccagtggcggttgccgcgccggagcttgaccgttcgggatcgcccctcgaacaccaccgtgccttcgtgagtaaaaatatgttccgccatcgaatgttcctttataacgtacagttatgctttacctctgcgcaggaagagtatactatcagctgactcgccaaagcgagcgaatttaatccaactttacttcggcaggaaagtggccgatactagcgccgccgcctgtactgccctccaaaacagaggatacattaaatgcaagaatgcaagatttcccgcgaccaactcccggtcggtaatccgaatcccaatgtcgacaagacccgcgacccgaacctgaagcccggtttcctgcgtcgcagccgcgagctggacccggcgctggccgttcgcattcgtcgcgagctgatccacgccgaagcgtccgatctggccaaggccggatgggtcaattcacagtccagcctttatggatcgaaagccttcccgcgccattccgtcgttcgcgtgaccggagttccggaagatggagctttcatcggcatgctgatcggcttcatcgagcatcgcgagcatggcgaatgggcggtcatggaagccggaacgaaagaaggcggcgccgtcattattccagtcgatcacatcatgcgagcgtcattcgccgaagccgaagagttcgccgaaaagtgggagcggaacttggggtggcgtctcctgcgccaactccgcgagtgcggcgccctggccgggactgaagacgagttcctgcggcggatcatcaatcgatacgttcgtgatcgcacgatcctcgatcaccacaaagtcggcgcggacaaaacctatactgatgcagtactcaaaagcatcggcgaaacatggccgaagattccttcggggaaattcgtcggacaccgagtcgcgcagctcctgatcggccacaagctaggtcgagcggggaccattctgaatgacctggtggacttcctggagaagttcgcggccgggcgcgataaagttctcaacatcgccatctgtaattgaggtgaagggatgaacaataaaccgacgctgaatcaccaccatcaaactgcattgttgtatctgtataacaatccaaatcagccggccttcacaggtcccaacaatcaggcgctcaatgaacttcggcagatggggtatgtaaaggcgaaagaattcgaaaactgggcaggcaccggccatcttaggatggaatggacgctcaccaaagccgggattgagcgcgtcgaagtcgggcttctggggaagtgcgacgcttgcaagggaatcggtcagactttgcttcgggggaagtgtactgtttgcaatggccgcggccaggggtggatcagcgaatggtcgcagaagccaatcgaagataatcctcaaattacccctaagttcgaaaagaccgatgcgaataggcttgcagacgccattgaagaaatcggccggctggaaaaggcactggccgaatccgaaaagcgcgggagcgagctggccgcgagctattgtgacggcgtagtcggcgatgaatacggccatccttattgtcgttataaagtggaacgcgacgccgccttggccgaagtcgagcgcctgcgagaatcaaaaggcgatccctctggcagcttcgacaggtgtatgaagatgatgtacgagcgcgacgagaatgcaaaacgactcgacgccgccttggccagggtcgcggagctggaagggaagttgacggactggttgcacgaagggttccggctcaacgaggcgctagcggtcgccaaggctcaacccagcgtgccggaaatatctggcatcggtcgcgatgccgaacatcccagagctgtagtgctgtatctgcgtaacgaacccagcgatgaagatatgcgagcaatacagaactttttgcgcgccatggccgcccccgctcagcacagcgtgccgaaagcatggctcgacgttcaggcagagcgccgccggcaggtcgaggcccaggcgctaaggcaggaagtcgcagcactgcgcgcaagggcggatgttttgccggaggtgttcgggcttgagcggtaccgcgtagaaaaaactgggaagggtttctggccatactgcgtgcgtgcgggggatggaacgcgtgaactgttcgtcggccacttgaagcagtgtcagcgggtagcgaccgaattggctacggcgtttgaagatgggaagtttatcgccgcgcccggcagctcggctcagcacagcgtgccggaggggtggaagctcgtaccgatggacccgacatcgcagatgacctatgtcggtcagtccctgcgttatgacgcggtaaacagcatcggcgagatttaccggcaaatgctcgccgtagctccctcacccatcgatccggccgcgcatcctcagccgtgccagcaaccacaggcccatcctgcccgctgcgggtgcgagcggtaagtgccaagtaaggaattcatgtaatggaacagaagaaaccttcaccagtagatggagtcatcgccatgaccagcctcgacgttctccggaaagcacagcccgaagcccaggacgagtatgccgtgtccatgttcgcaacggcgatccgccagaaaatgcagcgctcccgcgataaaggccgaggcggctggatcgactgcgacgaagatattctgatcaacggattcgccgaacatgcgctgaagggaaatgagaacaacctcttggacctggcgacattcctgatgttcatgtgggtgcgcggcatcgacgatgcgaagattcccccggcgctcgaaaaggcgcggcagcacaagatcatggaagcatggagtcgggtccacgaagatggactaaactccgccagaaaggcgagtgctgcgcgacagttcgtggaagtgcctcgacgcaaggggcgcccggagcgacttgcatgaagcctcacgaaataagactggcacaggccgaagagttcctgcgcgaactcggccgagggattccggacgacgaacgggtaatggttggctacgctgaagaggccacagtccaaaccgacgagaacggccgcaagctcaacgccggctggtggcctgtgccctggaaggaagggaaatacataaactcccgatccaacgcctacgcttgcatctcgtcatccatcaagacgcccaacccgaagaccggccagatgcgatactggcgcggcgaagcctctttcggccacggcctggcgttgatggtcgatgacatcggctccggcaaagggtccaaaggcgacttcgaccgcgacgaattccgcgagcgactggagccgaccgcgattgtggagacttcgccgaacaactaccagttctggtatttcttcaaagagcctatgtcacacatgctccagttcaaggcgctgctctattcgttcgtggaccaggtgctaaagaaaggcggcgacaacaccgtcaaggacgtcagccgttacggccggatgccattcggcttcaacaacaagcgcgggaaagacggcaagttcaaatatgccgacgaaaacggcaaacccgaactcgtgcgcctgtacagcgccgactattccaagcgctactcgccagaggagatcgcccaggcctttggcgtccgcatcatcatgccacagatgaagaaggtggagataaaccgcgacgattgggtgtatgaccaagtatggctgaagtatgccgagcacatctgcacgaaatacaagatgggcgaggcggcaggcggccaggtccagcagaatatgtccggcaaataccgcatccgctgtccctggggcgacgagcacaccaacggcgatcctttcggcgcatactttcgcggaccgatacctggcgccgagcacgaatatgtgttcggttgcgggcacgatacttgccgcaaagagcatcgacggacgtgggcggccttcactgatgaagtcgtcctgccgtatattgtcgaacaacttgaacgcatcaaccgccgtcatatcggcgaggagtagtaactatgcaaaatgatcctggaattctgatcacagccattggcttgctgttcctcggccttatcatcttcttcgaaggcctaaagggatggaaaatacaagtcgcaaacttcctcgcgtcgcttctgtgcttcttcttcggcctttctgctttgacgttctggttcgtcgttgcgtttgacgtattttaatcgacgaacggtacagaaattttcggatggggacggaacttattagctctgccggtttaggtaggagataatagccgtccctttcgcctcaatatgtagaggcagtgttatatccgatcatgtaaagcagaaggcggcaaacctaacatgattatcgacgacgataacattcttgatgatgacgaatcggggtccggtgagttcgatctcacgcaaatagaagatgctggaatggaccctttgatgaccgccgcaagtaaagcggccgatgatgcgattgcgaggaatgaaacgcaccgcgcacaaaaggcggcaagatacgccgaggcgtatgcggaaccagacttgagaaagcgagcgcgattgttgatgctcgaccaggcgttcgatcttccggtcagccgggtggtgaaaggtccgttcgatgacttcatcactaaatacagctcaacttccgacagcaactatctcgcggtctatgatacgttgttctgtaagggcgacggaaccgtcccgcatccgcacttcgatgagtttcgcggccggctggtggaccaccgaggcgtggcgttcaacaacaagaccctcgaccccattgacctgatgggcgccctcgcggctgcggccttggacgatccatcgattaagaagacgattgagacttgctgcgtttgggcgcgtcgatatcgccgcaactctttgatcgagacgtttgagaagaagataccggattgggacggcgaagagcgaattagcacgttgctgatcgatcttttcaagccgttcgacaccgagctcaaccgtatggtgagcaagtatttctggctgagcctgtactgccgcatcaactatccgggaatttcggcgccgatctcgttggcgttgattggtgggcaggatgcggggaaatcatatttcggcttgctgatctgtaaggaactgtccggtgggcgcgatctggctccagttcagctcgacctgagccgacacgaccagacgccgttcctgcgcaacatcaccggcaactcggttattgcgaacgtcggggaaatgtccggcttcaaaaagggcgacatggaacgcatcaaagaattcctggtgcgatcttcggatacattcgatcaaaaattcgagccgggcgaaacgatcaagcgacaatggatcaccatcatggacggcaacggatacgatggactccagcgggacgactccggcaaccgtcgattctatccgatgttcgtggcacaacttcccgacgaagatggaaagccgaactgggttaagccgggcgatggtaatgaaccgttcaaggtggacttcacagacttcggccgcaagttctggcaggctatggctgagtgccgcgcctggatcgaagagcatggcgtcgatggatacctgaatatggtgtcggaagctaaccgcgaagtgcagaacttctctatttcggaaatggagaatgcgcgtggcgtggttcgtgatgatacgattgacatgtatctgatcaacgttctgatgagttgcgagttcgaagaggttaagccgggcaggaattcaaagaatcctggatggagggctgacaccgtcaccattctgaaatggttcgatattctcgccaggaagaagccgatttctcgccacttaactccgcacctgaaggcgctggggttcgtcccgaacaagaacggcctggctggttggtgcctgcccgtcgataaggttgcgcctggatggacgaatagtatgcaaaccacgctgccgccgttcaatgatgcgcttgtgtacttgctgaggaagggcgacccggatatcactgatgaggccgccatggcaaagattcgggcagtccgggccgagcgagccaagattttgggcgaggatttctgatgtagtggttgagtgtacttggactaggccgccttcgggcggtcttttctttggtgcggcgtacattagattccggcgttgggcgggattggtagaagtgaatacagtaatttggaccagtttcgagcgcgaataatggaaagtcgatagattttcggtatcggtttagcgtgtatggtggacggattttgcgtgaaatgttgagaaattgcgtgtttgaggtggacttttcgtgggaaatagccgcaaattactgtatagcgattctgagcggtaatttgggaagcctactgccgcgtgggttagcgggccaatttcctaatttccggtttttcgagcatgggttaaaactattctacagcgaaaatcgattgcac

SEQ ID NO: 19 - DNA, 65844 bp, Myoviridae Pbunavirus
  misc_feature (1)..(65844)
aatcctaatagaaaaaatctatcacggacgttacctatctttaaaattaataaaattaatagtaatttggtaatttggtatactttggtattgaaagcctcgcggcactaagcttgtacatatcccgtcaagtttccgattccggccagctcgcggcagggtcgccggaaacttccagacttacaatccatgggtcgcggcaacaccacggcggactaagcggcaagcgccaaaactcgacgaacggaaccggaaatttgggagcgcgacagaatcgctcagctggacatatttctaacattcgatttaacactcctcccaaacactcaccaccatcctcacccaccaaccgccgactcgaccctcacccaccagcagaccgcccatataacatcctataacaccacctaacactcattcaccatcaaacccacccagacctacaggccacccacaagcagcccatagacgcgatccctggccccatagtacaatcgcgccatactcagtgtcgcggcagagcaccaggggccatccgccaaccaagccaccacgacgactccagaatcgaactcagggacgcagcaccaaatgaccaaattctacagccccgacgatctagtcacgccacaggaattcgcagacccgcatttcgcggcgatcaaccaaaagcgattcgacctgtacatcgacctgcgcgtccaaggttacagctcctggcgggtcttccgggccatctggggcgaggagcatatggacggtcccgcgcaggcccgcatcttcgcgatggagtccaacccgtactatcgcaagcagttcaaggccaagttgaacgcgaccaaaacgtccgatttgtggaatccaaagacggcgctccacgaactcctccaaatggttcgtgaccccaccgtcaaggactccagccgtctgtcggccatcaaggaattgaacgttctggctgaaatcacgttcgtggacgagtcgggcaagacccggatcggtcgcggtttggccgatttctacgcatcagaagccgaggctcagaccgcgaccgtcgctgctgcggccgaagccaatggctatgtgccggaaggtgaagagggagatttcccgtctccgtctccggaaccgaccgaggaagaccgcgccaaccccatttagacataaaataacatcgttctaggcccgaatcggaccgaactaaggcgacggtagcgggaagggacgaaaaacgattctagggcggttctaggaagtcgtagcctaaccctcagaaacgacaaagccccggactctagttcagaatccggggttttcttttgggcgccttattcgccagcttcgatgatttcgaagttgtatttgacgccttcgtgctcgaaagtcattttgccagccgccttcagctgcatgcggaagcggatgtgtttcgaagaaggcaggccgaactcgatgaatgctgcgttggtggaccggaactcgccgcgcttgcctttgacagtcacagccacgccatggcgctgagtgcgtttcttggaaacttccgggtctttccaggagttggcgatggctgccgacaggtctttggactctttggctttctccggagcgttcttggcctcttcgcgcatcttccggatttcttccagcgcttcctcttcggtgatctcttcttcaggcttcagattctcttcctcggccttctcttcttccttcttcttcttggaagtgcgggttttgtagactttggccggggcttcctcttcctgaaaggcttcttcctcggccggcagagcattcaggatggcgaggcagcgacgctcagcagtcttgcggtcagagaaacgcttgacggtcgcatcggcgttgtgagcgttgtagaaggcgaccagttctttcatttctgcgttctggatgtcgccgaaggttttgatggagttggtcattttgcgatcctctgttttggaagatttcgttcgggcttcggtttgtcgccctgttgaaagagattatgcctaggtcgatgctgcgtgtctacatttatttcatcagattgatcgcaaagccgacgaacggttgtctgatgtgaaaacaccgcagagcaggttgcggtgtttggtgggcgagggcgatggtcagaaagtcgggactgtgatcggctcgattggcgggtcgccgggcctgtcgttgtccgatgcgggcgccgggctggaagggatcgcacccgaccgaagcgccagcgattccgactgcctgcttacctgcggagctggaggcgcttttggcgcatgaggcgcgggcggaaccggcaggcctggaggagccatcggcgccctgggcggctccggaagatcgggcagatcaggaagactcggcgctatgccgccaaaggaccgctgcgacggattgtcgccgaacatttcggcggatcggttgtccttgatgacttgacctatggcagtcttgtcgccacccggttctgctggatcgaagcccgtgaatggagtggtaacgcagcgcatgttcggatgggtcggcagattgttcaggacgatggagtccgcccagacatacgggtttttgtggttgccgggtccgtggctgatgatctcggcaggaatatggccgttcatggtgagccattccgccatcccttgccgagtcagcgggcttaccacgatctgaccagtggactctttggcgatggcgaacagatcaccgaattcgaatccgatgattgtgtagttggacctggactcgccgacgaaagccagagtttcgatgttgtggtggatatcttggtcttcccagatgtacagcatggttcgctcctcaataaggttgcttttggtgttcgaccagagacataccggccggaactttgaagcggacgtattcgatcatcatcgccgttcgacgccgattcgtgcccgactcgtcattgacgaatagttcgcactggtgcggaatgactcgcgtcaccaggtcttcgcctttcgagccgtagaacttgatgtaggatgcgacgcctcgcgtcatgttcagacggatcgtttcgcagagtcgctgcgcggccgacgcgctagacagatcggtcggactgaccgtcacccagtaatggccactttgttctttatcggacataagctgccctccaatgagaaagcctctgcgactcggcagaggcttgttgttgttagtcgcgcttcaacagaacgactttgtcatatgcgcgatatttaccgcgccagtcttcccagtagtcgccggccgggcaggtaagctccagggtgatttcgtcgcgccagcattcgacagaaaggacaattgccttgttcctggctgcggaatccgccctgagcttaatcagaatttcgtcgccagttttcaactcatcaactcttacaacttttgccatggtgttctcctattgggcagcgccgcgagggcggatcgggtcgatgtcatgtaagcagatggtaggatagtccctggccaacttgagcttgaagtccacccagtcagcgccgatgagtgccgagacttcgatgcttactttgctgtgcggcgcagctccagatcgcaggactgtggcccgacgccgaacgggatcgttgacgtcaacatgagtgagtatttcgtcgccgacgagcaactcacaggccatcaatattttggccatcatacacccctatgagaaggcgcgcccaggacgatcccagccgcgccgatggattaacgtttgtgaaggatggacactgcgtccacgtcgaggatgctaatggtacggcgacggcgcggattgctgcgttcatggatgcgaatcaggttcgcagctggagcttcgtccaccacccatacgtcttccggtttctgcgtccggagcaggaccgtcacttcagtattctgggcgaggccgttgcagatgaaagtgaacttggacgagggagttctgtacatttcgagattcctttttggacttctggtccggcttctcagccggtgaagagattatgccctgattctcaccgccgagtaaagcatttgtgtaccaattctcccgtcaggtggaaccaaagtgcggtatcgcttatggctacgctaccgcgccatggcccttcttgctcgcacactgcgaaccacaggctgatttccatccttgccaggactcggccgaaagattcgaacctgcgccgactggacaggatgtcgacattcactcgtcgattgacctcataccggcgaccgttgatgacgaagaccagccgcagggtttgtccgtcaagacactcccagtatctggtttcatatcggagccaatagcgcttgccagccgggcctaccatggtcatttaatcgatgctcctggccgcgccacgcggtccggtcggcgggacgggatcgaaccgacccaggatgtagtcgggccggcgcgcttcctgaggacacacggcgagaaggcgccatcctgcgtccagggcagactggagttcgtccgtgcagcagtcttccttgagcagcagacggttgacgttctggagattcggaccaggtatggccgatcctgtgagtgagttccaaccctcgattccactcaccatctccggttggttgatgtagcttacggacataccggccaaccggctcgcggccagctccagacgctccagcatgggtcgcagagcagcttccgggtcaatgtcgtcccagagaaggaccaggctgatgatggtatacggatagtccttgtccagatcccaggctgaagcggtcaggcggcccaggccgatttcattacacataacgggaacgtcgttgctccaggtggacggctcccagttcccctcaccaggattcccgattgttacgccttccaggttccccaggagaacgtggagcttgctgacatattccgcctccaaggctttccgctcttcgtcggtctggttgtggcgatagaaggatggagggctgactttggcatggtagagtttcataactgttcctcggttttggaagatttgaaagttagagaatggtgtcgcagtatttctcgaaaggactctggcgcttcttctcgcagatcgcgcaggtgatttccaggtcgggcagctcgctgtaagtcttgccgagatacagccagcgcttgcacagactgcggccgtccgacgtgaagaagtggactttgcgagcattgccgggttgcggccagccgcttggtgccggcttcctgctcataccatcaccacgtcaatttcgtcggcgaagaagttaaagccaactccatctgcgtagccagtgtaacgcagacgagtcgtcccatcaatgtgggcttcctcgacgccgatgacttccagggtggtatcgttgcagtacagcttgacgaacatcttgatgccggagccaatcgccgcgaaggcgatctgcttgtacaggtcttgcttgatcatgctttacgctcctgtttgcggatgtattctgccctgacttcggcttcgaacttcgcccagagcgcgttgtctactggaccccagggaccggtctgagttccgtccaccggcgcgaacttgccaccggcgcgacgatacttggacagcgttctcaggctgatgattttctcttcttgggaatcgaattggacgatcacttgacatacttcccgaagtagcaggtgtggagtatttccaggcctttggagatagccttcagcttgatgccgaaattcttgatcgcccagtccagatcgtggtgatagaactcgatgatgttgacgatttgaccggcgctgtagtggatgacgcgaaccttgccgttccagcggaaatcttcgcggctgtttacggcctcgactgcgatggtgtcgtttctgccgatgttccatttggagctagtcatgtcgcaatcctctttttggagtgtttcgcgttcgatgaggtaactatacctcagccacctcatcgagtaaagcattttcttcagattatctgaaaccttttgaagacaggaattgccgccagagccagtcgatgtgttcgttgcagtaacgctcgccatcggacgacatagataaggcgccatcattgatgccgaagtgggcagcagcgagacattcgaactcgaactggagcgttcctgggcgagggatatgggacatggcgtatttctgcacggtcagtgatcctcagaaggtttagcgtttgcgatagccgctactttctgcataccgaggcgatagaaatcggcttctttcctggcttttgtaagctgctccatggcgtcgcacgccgtcttgtgctgggcattggcgttcttgatgctgccttccaggctcttgtccagctcttcccggagcgccttctgcgatgctagctctgcctccaaatcctggattctgagctggagctggcgatttgtctcgccaacctggttttcgcgggcgatggagttctgaaggcattcgtcaaggcgagtattttcgcgcaccagctgatgcttttcgactttcgcctttctgcacgtctctcgcatttctgaaagctcaatcgcatgcagatcgtcatccgggtctttacgctcttccttcgactccatccgcaggtagtactggccggctgcgaaggcgagcactgcctggtcggcatacgctgcggcatcggtcatgtatctggatttgtagcgaggcagaaacttgcactcctctggatcccagaggagactatcggcaataggccagaatttgcggaagccatcaggatcgacttctacattgaccatttgcagctggccggcctccacttcgacttccagaggaacctgaatggcgccggtgatgtactggaagtacactatgctagacataacacaatcctcataagaagtcgcggccgggaccatcccagccgcatcgtaatcactcttcgccttcgtccgcgctcagccactcttcgaaggcgaaatttaccttagactcgacccaatcttgaagctcatcggcgaactcgtcactgtcgatgtccatcggaatgcccagagtctcttcgttccacagttcggcattcagttcgaactggatagccggttcgccatccacattcagcaggatgcggtctgcgacttcatattcgtcgacatcgaagaggaaaccgccgctgatgatgtgctggatgaaagcttcgtcgaagttgctgatgccgatattgatctgcttagtcattttttctggccccttatttggcgagtttgtactgagctttgagggtggtcagcttagctttcagggcgatcatagcctggccgcgcaggccttccatttctgcctcgctgatggcgatcttggcggagcggatttgatcgttgatctgggatttggtcatttctgcgttcctctgttttggagtgtttcgcgttcgatgaagagattatgacgctattcagaatggaagtaaagcagaattgtgaaatatttctcaaagtggacgaacggtatgccccgtcaggaatatttcctcccatggaaggcatttccgcatccgaatgttgattaggtatcccaaagcgcgcagtggcgaatgtgagtccgcacgtacatagggttgtattgtgcgaagtgctcgacggtcgcatccaaggctctgctattgccgcacccttccgctttgcgagccaggaagaatgcttctatttgctggtttgcgttcatcgtcttaccctccaggtgtttgttcgtttcgatgaagagattatgccgttggtcagaatggaagtaaagtgtattaacaataaaattatgttcaccgacgaacggttgtgctcgaccgtccgttgcggcgtcgatatactcgacctattgctgacaccggattgattagaatgtacaaactcaaccctgcactgcgagcagtctggcgaactcgcgcccgttacaaagtcatttatggcggccgggcgtcttcgaagtcacacgacgcaggcggtatcgccgtttacctcgcggccaactatagactcaagttcctctgtgctcgccagtttcagaaccgcatcagcgaatcggtctacacgttgatcaaggacaagattgagaattctgagtacaacggcgagttcattttcacgaagaactcgatcaagcacaagatgaccggatcagaattcctattctatgggatcgcccgtaacctgtcggaaatcaagtctaccgaaggcatcgacattctctggcttgaggaagctcactacctgacccaggagcagtgggaagtcatcgagccgaccatccggaaagagaactcagaaatctggatcatcttcaaccctaacgaagtcaccgatttcgtgtatcagaacttcgtggtcaagcccccgaaagactcctgcgtcaagatgatcaactggaacgaaaatccgttcctcagtgagacgatgctcaaagtgattcacgaagcctatgaacgcgaccgggagcaggccgagcacatttatggcgggattccgaagactggaggcgacaaatccgtcatcaacctcaagttcattctcgcggccatcgacgcccacaagaaactcggctgggagccggccggatcgaagcgcatcggcttcgacgttgcggacgacggcgaggatgcgaacgccactacgctcatgcacggcaacgtcatcatggaagttgacgaatgggacggcctggaggatgaactgctcaagtcgtccagccgcgtttacaacctggcgaagatgaaaggcgcatcggtcacttatgactccatcggcgtcggcgctcatgtcggttcgaagttcgccgagttgaacgatgccagcccagacttcaaactgatctatgacccattcaacgcgggcggcgctgtcgataagcctgatgacgtctacatgaagctgccgcacacgattatcaagaacaaagaccacttcagcaacatcaaggcgcagaagtgggaagaagtcgcgacccgattccggaagacttatgaagcggttgagcatggaaaggtttatccatttgacgaattgatttcgatcaactctgaaacgattcacccggacaaactaaatcaactgtgtatcgaactttcgtcaccgcgcaaagacctggacatgaacggccggttcaaagtcgagtccaagaaggatatgcgcgagaaacgcaaaatcaagtcaccgaacatcgctgactcggtgattatgtcggccattctgccgatccggaagcccaaaggcttcttcgacttataaacatagaaaagcccggatcgctccgggcttcgggtcttactcggtgcggttcctggcgctgagtgtcgacgcaacggcctcgccgactcccagggcttcctggccggccgcgagcgcttcggcttccgactcgacgatgaaatcatcaccttggccatcgcctggcggaacctcgaccagcacggcttcttcgccttcgaaccgcaggtcataggtcttttcgacggacagaccgtaacgagcgttgagcgcgtcccagagctgggcctcataggtccgcaggtcttgcagagctttctggtggctgagcatggccatgtcaacggcccgttgcagggtttcgtccaggacgttgaaccgaatgcgaagagaacgaatccgctcgacgacttccgcatccactacatgtctttcgatcattacttttcacctttgctgaatgtaacgttgtagccgttgtcggccaggtaggtcagggcgccttcgaaggaagttccgacgaggtgctttagcttcatttcgcgttgcgcggccagccagaatgcagttccggagaactcggcgcggccttcggccaagaccctgccatcaggcccggcgatccgtacatgcacggaagatagcttgatcggcatcagtgaatacctccactggcttgcgacggcatgctttcggcgcgtgcggcttcgcagtccgggcagggacatgcctggcggacgcgctccagctcgtcggcatccatgacatagagcttcccatcggcagtgtcgtgcgccatggcgatgttcgggaagtcggtggcgctcaggccggcgacagcgcggatttcgtcccaaagcaccagatgctcggcattcagtcgggcggcgagcgcttcgtgctctttagcgacgcgcgccatgaactcgtccacccggaatgcgaattccgcatcgatggcacgggccgaggccatggagctgagtcgaatcggttctttcttcatgatgattctcttttggttggcggttgttcgctgctcaggcctattacagtctgagcagcatgatgaagatgaacgcaaggaacgcaaacggcacaagtatgccggacatcagctttgacaggcgctgcatctcagcgtatttctcggttgacattccgtgctgcgccgcctcagctgcgaagcgggctttcgcctcgataacttccgggcgtagcgacaggacatattctaaggcctcttcccgcgctttttcggcctcgaccgacctagggtcgcgggcagagacttcgctgtgccctggcctcgcgggatgggcttgcagagatggaggaagttcagcagccacgactccatagtcggcgcaggcccaagcgatcccgatgaggatcgcgaggatggattggacgattcgcagcatcactttgtcgctagggaagttcataatcaatcctccaccgaccgaacgatttccatattgcgcccggcattggcccctgcattgaaggcgcgccgaccgtcgctatcgtccagacgcatgagcttcgtaacattggacttcttgtagccaggatcgccgaaatgttcgtgaaccgcagcttccttcaccacaaccagagacgttccggcagaagataccagctccatacgcttcctggttatggactgaaggcgatagctgatttcctgggtcgcggccagtttgaattgcgcggcaacctttacgttgaaacgttcgtacccttgcgccttctgatactcccgacacagacgatcaatggcctcgaccagggagttgaacatgttcaccgccagctcaacgtccgacttgtagcctttgaagcgtacggcatgaccccagcgcttggtagtgcttccgtcgcgggcgctcctggatgccttagccgatgctctgtggttgttgatgccaccggcgaaatccatgatgcagtcattgtatgtcgccacggccactgagaaaaacttcatccagttcgggattgcggaatagtaacgagtggcaatttgctcatcgaactcttcgcgaatctcgccggtagcttcgaagtcgtgaaggtcatatttgtccttcaacttcttcacacgctcggctgcgatggccgcttcgtgcggactggaagagtcggctgccatggcggtcagtttgcggatgcggtctttcgccttctcgatggcttcaggggtgaattcgttctggtcggtcatggtcggttccttttgtctgaagggtttcgcatttcaatggagctattctgccttcattcagaatggaagtaaagcactttcttccactatttcggcatcgactggaagaaattccagatccaatcacctgctaccagcaagaggatgagggcggcaaagaacaagacagcggccgcgagctgtgcgcccggcttcagtttgggatggctgagcttgggctctacgggaacggccggagcgctagcgctgcaaccggcgtctcctgggccgtagccgatgccgcgttcacacgcctggagcgacaccagggatttaagatactcggtctgcttttgcgactcttcgtagatgccggcgacggcgaaccagagggcgaacactacggacgtacacacaacccaggcgccggtcagcaggagggccagcgggccgatgacgaagacggtagcagccaggacgattgcgccgccccagatgatgaagccggccagaccattagtgatgtcgacacagaactttttcattttcagattccttcggttacgggatggaggggatttgaaactctgcgccgccgagaacatcaatgacgacttcccagagcgtcggaacagaccactggtaacggtcgaagtcggtttcaggatcgacgcccagcgtcacataggaagtggcaggccatttatgagcactgcctttccgcatgagagtcgccacgcggccgtcaccgagcggattcgtcctgtgcggaacgtacgcagacatcgaatattgctgcccggcgtcgataacaaatctttgcctctggcgcagacatacagagcccacaggattccagccgcgaccgccgcaagcctggcgagccgaagaatgctcataaccttcgtgagtcatttcgctgaggcaagccgagcgatcctcgtaatagttgatgttctccatcgatccaaccagcaccagagactcgaaatcgaatcgatgatcgtggatggccgagtgattgaagcaaagccgacgcggcagctccgggtgccaaacatggaggcgaccggccggaagttggacctgaatgaaccccaggccgtgcagagtgatcttgtccttcatcgggtcatggacggtgctcatggataatcctcagtagcagaaatgtattgtgagagttacgattgataagccggtcgcccatagaagggcgaaccaggccatggctttgatggtcgtgtagatcatccgaagaattttccggcacagatcgggccaatgcccatttcgatggatgcgtggttggtcaactcgcgaccgcagcaggagcactgaccagtcttccgaccgtaggcgactgccgattccatcggcttttcgaacatcttcagaacgtcgtcgtgctcagtatcggtgcagtcgcgactcttgatgaatttgccattggtgatccggccgaggtagatgccgcccaggacgtacaggctaccggcgttccggctgtgagcgctagcctctttcacaacaacgatgagcggctcctcgccttcgccagctaggcggattttcgggcgcttgataccagactctttcgccttctcaaacgctttctcgatgccggaaatgtccagagtcggcgcagcagcttcctgcgctgccactttctcgcgatacttggcgaggttttcgatggcgcgcttcgcagcagcgatctgattttctgtcaaggagccgtatttatacaacgactcctgaaggctctgagcgaagctgaaggaatttccagtccaccactcgatgatgtccgggtgcgcggcttcgaaggccttaattttgaggtcgcgctcttgcgcagcgctacagattttctcgatgcgcttttctgccgccttagcacggctcttggcgcgctgctccgggctggttttgtactctttgtatccgacgccgccgcaggcaaagcaggcgcgaccataagacgaagggccacggtacaggccggtgcctgcgcatttggtgcacttgtcgcgatacagcttcacttccttccgggagttcgggcgggcacccatggacacgtcttccagggtcttcggcgcttcgttgttgatctctacggtagcgaagtcatcacccaggtcttcgaagccggtgaacagattctctgctgcgttcatgtcgattctcctgtttggaaagttcgtttcgatgagttgactatacgccagaaatggaaaaacggtagcgatttctcactaccgttcgtcgggtcgaagacaatcaataaatgtcgctattgatcttgaacccatgctcagcgccgtcgttgtagtcgtactcagcatagctgtcgcagtagtcgttcaaatgctgaatgatgcctagaacgtcgttcgcggcattgtgccgtttcgcggcgatggtcttggcgatgctgtcgccgacttccagggtttcggccgtccggcgatggatcagcagacggctccaaagatagagccggacgcgacgaatgatgtctcgatggcgctccagtcgtccgtgcaactcttcaatttcttgctcgcgagatttcactactcgtcgaagctgctgaacttccagttccaaatcggccttagtagccatgttcacctcaaaaaggaaaatcgtctgggactccaggaagttcgacgattattgttgagcctgatcgatccagaatgcatccgaccgagccagccctgtggggatagggtctacacgaactataacaggtaacttccatgactattcgccaggtcgatcctccacaccatctacagactggtgggcgcttcgacttcagttttcgttcgtccaagacggcgcgtctgtcgcatgaaaggcagcgcgccttaaccgacgtaaccatgggtatagtcgatcattcggatgagaccatcatcctctgattccctcgacttcagaccgcccaaagagtccgactggccgttgcatttcgcatcgatatccatcgaagacaggaatcctgccgatactgcggtgatatcaactttgtcgccggccttcttgaagtcttcgcactcagcatcgagggccacaattgcactcgcggccatgttcacatgactgatgaggtcggggaagatcacaggaacttcacgcgacatgccacggaccgtcagcttcaggactacatacttcatactcactatcccttttgtatgtgaggaaagaacttgctgttttccggatggtgaaaacgctcggtcgcaggcggtctttcttccggacattgaatcgtcgaaggcgggaaaaccgcgccggcgataatcgccgcgaggagtgcagcggatgtcgacatccagagggcggtttccaggctcacccgaacttccggacggcgcggcttcattcgctccaccctcttcctggctcataggatggcagaccgccgccgcgaatccaattgtcccacatacggttcagaccagtcggtggctggggcggcggactgtagaatccgggagtctcagtgctgctcaggaaataaggcgtgcaaacggcctggacgaccaattggtgccgctcccacatcttatcaatcgctcttagcatgacgtcttcgcactgagccttactgtcgaaccgtctgctagtatggtccggcatctggacgcagccgtctccagtgcaaaggaaagcagtagcaatccatacggtgatactcgccatttcgtcaccctctttagttgatgagcagagtctattccatctgctcgccaggagtaaagcgcttttcgtcgggataaatgccgatgatgtctgcgtcgagcatccaaatctccacggacggatcgtcgctgctgatttgatataggttgtacagctcccgtccgccgacagcacgctcgcctcgtggctcaaccgccagaaccttgccgtgtccttctccgtgctcgtccaggtatatgacgtgatcaccgacttcatagctttctttcgtgacgaggcgtgaacgcgagctgttctgcgattccaccatccaggaatccagcacgccgcctttcatgtcgcgaaacaatcttgccgatttgtcgcaatcgaatacgcccagaacttcgccgtctttcaacacgatatgtacgattggcaaaagagtattcatgtttaatctccattggttgataattagagtctaatctgccgaaaagttcccgtaaagaattattttctcataactgattagttgcaactgttaatctgatgtatatgtttgaatctcttttgaacgtttgatgtttcccctataataagcgcacacagtcaacaaccacgtggaactacaatgtttaaactttcctggatattcgggcgcaaaaaggataatgctgcctgttcggaatcggcgccggagaaagtcgcacaaatccctcaacacgatccgctcgaccccatgatcaagctgggaaggattcgcggctggaacgtcgagccggagaaaaccccggtcattcgtagtgtgaaagatttcctggagccgggcctatctgtagcgatggatagtgcgtatggtgatggaccaactccggccgcgaaggctgctgcgggcggccagaatccctatgtcgtcccgactatgttgcaggactggtacaattcccaagggtttatcggataccaagcttgcgcaatcatttcccagcactggttggtggacaaagcttgttccatgtctggggaagacgcagcacggaacggatgggaactcaaatcggacggcaggaagctatccgatgaacaaagcgcgctgatcgcccggcgcgacatggagtttcgcgtcaaagacaaccttgtcgaactcaacagattcaagaacgttttcggcgttcgtatcgcgctgttcgtcgtggagtctgacgatccggactactacgaaaagccgttcaatccggatggaatcacgcccggctcctacaagggaatctcccagatcgatccatactgggcaatgccgcagctcactgctggctcgacggcagatccgtcttccgaacatttctatgagccggatttctggattatcagcggcaaaaaatatcaccgcagccacctagtggtggttcgtggaccgcagccgccagatatcctgaagcctacatacatcttcggcggtatcccgctcacccagagaatctatgagcgcgtgtatgcagcggaacggacggcgaacgaagccccgctgcttgccatgtcgaagcgaaccagcaccatccacgttgacgtggagaaggccatcgcgaacgaagaggccttcaacgctcgcctggcgttctggatcgccaaccgtgataaccacggcgtgaaagttctgggaattgacgaaggcatggagcagttcgacacgaacctggccgacttcgacagcatcatcatgaaccaatatcagctggtcgcggccatcgccaagactccagccacgaagctcctcggcacttctccaaaaggattcaatgccactggtgagcacgaaacgatttcttatcacgaagaactggagtccattcaagagcacatattcgacccacttcttgaacgccactatttgcttctggcgaagtcggaagaaatcgatgtgcagctggaaatcgtctggaatcctgtagactccacgtccagccagcaacaagccgaattgaacaacaagaaagccgctaccgacgaaatctacataaactctggcgttgtgtctccggatgaagttcgcgagcgtctgcgcgacgatccgcgttccggctacaaccgactcaccgacgatcaggcagaaaccgaaccgggcatgtctccggaaaacctggccgaattcgagaaggccggtgcacagtcgacaaaggcgaaaggcgaagccgagcgagccgaagcccaggcgggcgccgtagagggcgcaggcggcccggttcccgccgctccacgcgggactaagcctctcgcgaaagcggccgaggaaggggccagcgaggccgctgaaccgccgtcgcgaccggaccccaaggccgagctgcggaacttgttggtcgatcttttgtcgaagctccaagacctggacgacattaaggcgccggacggcgtagacatagagcacaatgatgcgcctggcttaaagcgcacatccaaacctggcgtgtctggtatggagccttcggtgttttcgtccaaccgcatcgtcgggcctcgtgatcattcggaactccagagaatcaaggtgaatggaataaccaccttgatcgaaaatccgcgcggaagcattcgacaaggcaaggatgggagttggcgagttcagatgaaacaccactacgggttcatcaagggaacgaaaggcgctgatggggatgaagtcgattgcttcgtcggtccgaatctgggatccaaacgggtcttcgtcgtcaaccaagtgaacaaggaaggtcagtttgacgagcacaagtgtatgctcggcttcaacaacatcaacgatgcgaagtctggatatctgtcctgcttccgtccgggctgggatggtctcggctccatccatgaagttgacctgcccgctttccgtcgctggctggcgaacggcgacaccaccaaaccattcgggggcgagtgatggcattcaaggcctccaaaaagcgcgagcgccgggcacctcttccagtcggaagagggaagcccataattccatcggcaggaatcgaggcctggtatcgaaagcagatgaaggatatgtccaagctcatgatctccgactatcgaaacgagattgagaaggcgctgtcccagcctgcggccgaacgtttcttcgccagagacgaatccgttaacgtcctgttcaagatgacccttcgaagcctacagcagcgatggagccgaatttttgaaggtttcgcggccaagatcgccccggagttcgtcaaccggaccgaagaagccgctaccgccgcgacccttcacagcttgtcggtggccggcgtcgatcagccacgagctgcgtataatgagagcgtcaggaacaccctggaggccgcaaccacttacaatcatactctcatcaccaagatccaagaggaagtccacgagaagatttacacatcagtaatgctgtctctgacttccccgaatccggaagagcaaggaacttccggcataactaacgcacttcgcaaagtcgggaagttttctgaagatcgaatcgaactcatcgcaagagatcaaacaagcaagctttacagttctctgagcgatgagagaatggcggaaaatggagtcgaggagttcgagtggctacactcttctgccggcaagactcctcgccacacccacctggagaaagatgggaagaggttcaagctgaatgaccccagactttgggagggtccgaaagcagaccaggggccgccaggatgggcgattaactgtagatgcagaaagataccagtcatttgacatcgataggagcgctatatgccgttagttcatggcacttccaatgaggctcgttctgaaaacatcaagcgggaaatcgaagccggtaaagacccaaagcaggctgcggccatcgcttattccatccagcgcagtgagaaagggaagacggcgaaagattgttcgcctgagctcgtcgccgatcttcgcgccctggtggacgctctgtcgaggctcgtgaaatgaaccgcaagacgtgccggcgccgactcgtggtcgatgtaatcagggccaatattcacggcggattcttcagcctgaagtttgccgccatcgatttggcaatcatcggcgtcgccatcttgatggcttttggccgataatgctgagaaaaatctggattctgactaaaaattctagtccggatagccgcaagttaccgtttacggaaaatagcagtaatttggaaatcctactgccgcgaggctttaacagagccagttcctaatttccgatttagccgcatgcttcaaaagtatatagcctgggaaattagaagtaacgttccaatagaattcatctataagtaacgttataatataacgtcaatctatatgctctagacgtattgaaattcaatttttaatcggtaaattggtaatttgaattagtttaggagttgaaagcctcgcggcagtaggcttagacaaatcccgtcaagtttccgagaccaaattaccggattttcgcggctgaggaactggtaattagatcacaatacaaattataatgtaagttaacagtcacggctacatctaattattgttccgcttatttacccttagatgtactgcgtatataatacagccatagtccacgactcttcgaactaacgatggcaaagtcgaaaagaaaaattgacgaaaatggatatatgaccatagagggctgcccgatcagctcttatggcgttttccaatattctgctggtcaactcggtcttccgggcgatccgacgcggattgtcaacgtatatcgcccggagtctgccgtcagcgatccggagtacatcgaatctctgaagaatctcccgttgatcgacgagcatgagatgctgtcgggattcgacgatgatgacgatagcgtggcccccgaagacaaaggggtggagggcatcatcacatccaacgcttactacgaagccccatgggcacgcggcgatatccgcatctattcccgcaacatgcagaatcagctggaaaggggcaaagaagacctgtccctaggctatagttgccgctacactgagcaacccggcatctggaacggaacgccttatgaagtcgtccaggacaagatgcgcggcaaccacattgccctggtaaaagagggtcgtgtgccgggggccagagtattggatggtctgtgttttgaccatctcagttttgatttcagaccatccgatgagggtaatgaaatgagtctcaagaaagccaagcggaagccccctgtccagcgcgtagggcaagctgctgactcggcggtcgaagagttgcgcgccctgtggccgaagctatctgcgtctgtccagaagttcctgggcgaagaagagcaggagccggagcatcaggaaggcgccgctccggccgaaccgaccgacagcgagcacctgaccgagcatccgactctggaaggtgctcagaaggatgacgaagagcaggaagaggagccttccgttgtcgatccggccgtggccgccgtcgagccggagcatcaagaaagcgccgcatccgaaatgtccggtgaaggcgaagtcgccgaactgatctctcaggtcaaagccattctggctcgactggagggcacggtagccgaaggggcagacgaagagcatggcgaaggtcaagatgtcgtcgagggcttggaggagcagagcagcctcagcggctcgcaaaccgccagcgacgatggtggtgagagcaaggataacagcgaggaacttcctgaaatggcacagaagaacgcgcaagatgctgcaattcgcggtctctatcgcgacattgctgctaaagatcgcctctacaagcgtcttagctccgtggttggtgcgttcgatcaccgagctatggactcggctgaagtcgctgtttacggcgtgaaaaagctgaacatcagctgtgcgaagggccaggaagctctggcgctcgacatgtacctgaaaggcgtcgaagcctcgcgcggcgcggccagccgtcaatcgaaagcccaggattcggccggttctgctccgcagtgcgccgagctggacagctacctgaagggggagtaactcatgttccagaaacaagtttaccgccagtacactcctggttttccgggcgatctgatcgaggacggcccgaagcgggcgcggccgggtcgaatcatgtctctgtctgccgtaaatccggctgccaccgccaccggccccaaccgcatcagtcgcgctttcggttatgccggtgacgtcagcgccctcggcgaaggtcagccgaagaccatcgcggctcgtgcttctgaagtcgtgatcggcggcgccaacttctttggtgtcctcggccatccgaagcactatgctctgttcggttcggccggagactccctggctcccagctatgatctgcccgatggcgccgaaggcgagttcttcgatatggccaccggcctggtcgtcgaaattttcaacggcgccgcaaccgccctggacctggactatggtgacctggtcgcctatgtccccaacaacctggctaccgccgacaacgcgcttggcctgccggcaggcgccctggtgggcttcaaggccggctccatgccgaccggcttggtccagattcccaacgcacgtatcgttaacgccatcagtctgccggctcagtcggcggggaatctggttgctggcgttaccatcgtccagctcacgcagtaaggaggcgtcatgagccagatcagcaagacccattcgcgcctcgcaggccgcaatgcgaaacctttcgacctgaaaaacatcaccaatgacgccgtggcgtctctgcgccgcatcggcctggtattcgatcacgccgtcgtccaggaccagatcaaggccttggcgaaggccggcgcgttccgctccggctcggccatggacagcaacttcaccgccccggtgaccacgccgtccatcccgactcccatccagttcctgcagacctggttgccgggcttcgtgaaggtcatgaccgctgcacggaagatcgacgaaatcatcggcatcgataccgttggctcctgggaagatcaagaaatcgtccagggcatcgtggagccggccggcactgcggtggaatacggcgaccacaccaacatcccgctgaccagctggaacgccaacttcgaacgtcgcaccatcgttcgtggcgagctgggtatgatggtgggcaccctggaagagggtcgtgcctcggccatccggctgaacagcgccgaaaccaaacgccaacaggcggccatcggtctggaaatcttccgcaacgccatcggtttctacggctggcagagcggcctgggcaaccgcacctatggtttcctgaacgatcccaacctgccggcattccagaccccgccgagccagggctggtccactgccgactgggcaggcatcatcggcgacatccgcgaggccgttcgccagctgcgtattcagagccaagatcagatcgatccgaaggcggaaaagatcaccctggccctggccaccagcaaggtggactacctgtcggtaaccacgccttacggcatttcggtttcggactggatcgaacagacctatccgaaaatgcggatcgtgtcggctccggaattgtccggcgtccagatgaaaaaccaagagccggaagatgctctggtgctcttcgtcgaagacgtgaacgcggccgtcgatggcagcaccgatggcggcagcgtgttcagccagctggtacagagcaagttcatcaccctgggcgtcgaaaagcgggcgaagtcgtatgtggaagacttctccaacggcaccgccggtgcgctgtgtaagcgtccgtgggccgtggtgcgctacctcggcatctaaccgatgcctattcaccaaaggccgggtttccggcctttgttcactctgactctgactcggttgtaggggccggttagggcataattactaggactacgccaatgactgtttacatcgtttccgccatgactcaatccgtgtcttacaatgcgtatgacacctctgatccgtccaatcctcgccttcagcgaaagattctgattcgtggccgcgccggcatcgcatccgaaacttccggcttcggcgacatgatttccgacgcggccgggcgtccgatctggaccccacagggcgattgtactgccgtgagcgattcggatttcgagctgcttcaggccaataagattttcatgcgtcacatggagaagggttatctgcgagtcgtgaagaccgacatcaccagtgaccacaagcggatttccaaagagactcgcaccatggagcgcgatggattccagcctctggatgctactcgcctgcagcagaaaatcaaggtgaccacggccagcgcttcccaggaacaagagttccggatttaaccgagggtttcggtatggtgattttcgacgaacataagtttcgcacgctgtttccggagtttgctgattcagccgcttatccggacgtgcgcctgcagatgtacttcgacattgcgtgcgaattcatttctgatcgcgattcgccataccggattctcaatggtaaagccctggaagcctgtctgtatcttctgaccgcccacctcctgtcgctgtccacgatgcaagttcagggcgcggctggaggtggcgtcactgccggtgggacccagggcggtttcatcaccagcgctactgtcggcgaggtcagcgtggccaagctcgcgcccccggccaagaatggttggcagtggtggctttccgggacgccttatggtcaagagttgtgggcgctcctcagcgtcaaagcggtgggcggattctacatcggcggtcttccagagcgccgaggcttccggaaggttggagggacgttctggtgatccctggtgcgaatcttctgcgaatggccttcggggtcatcggtactcaaattgtgaaatatcgcaagtttgagcagcgagtgaagaatgatcaagctcagtacgtttccatgttcgaggagcctttcgacctggcagcgtctgttcagcgagtccgacgcgatcagtatgtccagtttaatctggagttccaacggaattacgttatgatcttcgccaactttgagatggttgacttggatcgcgatgtggccggtgaccagttcctctggaccggaagagtctttcagctggagtctcaaggctcctggttttatcaggacggctggggagtttgcctggccgtggatatcggtgcggccaagctcactgatgacgggaaaccgactttctaggtgatgtatgtttgacggcgaactgatagcgaaactggttgtcgagttgaatgcggcgatgacatctgctcaagaggctttgcagttcccggattttgaagtcgtccagaaagctcagccgacccaacagggaacgtcaaccaggccgaccatctttttccagaagctgtttgacattcctcgcggctggcctgccaccgattggcacctggacaacacggcccgcaaatatgtagaaataactcgacagcatgtagagacgactttccagatcagttcccttcattggcagaatcctgaaatcactcacgtggttacggcttctgatatcgccaactatgtgagagcttatttccaagctcgatccacaattgagcgcgtaaaggaactggacttcctcattcttcgcgtgtctcaaatttccaacgaggcattcgagaacgacaatcaccagttcgaattccacccaagttttgacatggttgtaacttacaaccaatatattcgcctgtacgaaaacgcagcatattcggccgatggggtattgataggcatatgagtctgaggcgcgattcagagctaatcgccgcgcacctccagatgttaagagccatgcgcggcaggtccgtttcagccggatggtattccacggctcgatatcctgacaaggcaggcggatcggtcggaatacaagtcgcgagaatcgcacgtctcaatgagtacggcggaactatcgaccatccgggcgggaccaggtatattagggacgccattgttcggggccggtttgttggcgttcggttcgtcagaaacgactttccgggagaaaccgaggtaactaagcctcacagaattaccatcccggctagaccgtttatgcgatatgcttggaacttgttttccgcagatcgcgccgcaatccagaaccggatagccatgaggctggccagaggacagatcactccagatcaagctcttgcccagatcggcctggcattggaaggatacatagccagaagcatcaggaccgggccatgggtggctaactcagcatctacggtcaggagaaagggattcaacagaccgctggtcgatacggcgcacatgcttcaatcgattagcagcagagtaacataaccaggagatcatccagtgatcagtcagagccgttatatccggatcatttcgggcgtaggcgcaggcgctccggtcgcaggccgaaagctgattctgcgcgtcatgactaccaacaacgtcatcccgcccggaatcgtcatcgagttcgacaacgccaacgcagtcctgtcatacttcggcgcgcagtcggaagagtatcagcgggctgcggcttatttcaaattcatcagtaaaagcgtgaattcgccgtccagcatcagcttcgctcgctgggtaaacaccgccatcgcgccgatggttgttggtgacaatctgccgaagaccatcgccgatttcgccggcttctcagcaggggttctgaccatcatggtcggcgcggccgaacagaacatcaccgccatcgatacgtccgccgcgacttctatggacaacgtggcgtcgatcatccagaccgaaatccgcaagaacgccgacccgcagctggcccaggctaccgttacctggaatcagaacaccaaccagttcaccttggtcggcgccaccatcggcaccggcgttctggccgtggcgaaatctgccgacccccaggacatgtccactgccctcggctggtccacctccaacgtcgtcaacgtcgccggccaggctgccgatcttcccgacgcggccgttgccaagagcaccaatgtcagcaacaacttcggttcgttcctgttcgccggtgcgccgctcgacaatgaccagatcaaggccgtgtcggcctggaacgcggctcagaacaaccagttcatctacacggtcgctacttccctggcgaacctcggcgctcttttcaccttggtgaatggcaacgccgggaccgccctgaacgtgctgtcggcgactgctgccaacgacttcgtggagcagtgccccagcgagattctggccgccaccaactacgatgagccgggcgcttcgcaaaactacatgtactaccaattccctggccgcaacatcaccgtttccgacgataccgttgcgaacaccgtcgacaagagccggggcaactacatcggcgtcacccaggccaatggccagcaactcgcgttctaccagcgcggcattctgtgcggcggtccgaccgatgcggtggacatgaacgtctatgccaacgaaatctggctgaagtcggctatcgctcaagcgctcctggacttgttcctgaacgtcaatgcggttccggcgagcagcactggcgaggcgatgaccctggcggtgctgcagccggttctggacaaggcgaccgccaacggcacgttcacctacggcaaggaaatcagcgccgtccagcagcagtacatcacccaagtcaccggtgatcgccgcgcctggcgtcaagtccaaaccctgggttactggatcaacatcaccttctccagctataccaacagcaacactggcttgaccgagtggaaggccaactacacgctgatctattcgaagggcgatgccatccgcttcgtcgaagggtcggatgtgatgatctaatggtttgcggcggactcgatccgccgcaaccttccataaatggagtgaggaataagcaatgatcaacatttctgcgttcggctcgatctgccagttcacggcaagcagaactttcccgaacggattcaccgtcaccgagttcgccgacgatgccgatcccatcgacagcccgccgttcaccgctgccgataccggcgtcggtctcaacggtgacatggtagtttggaaccgggcgaacatcctggaagtagtcgtcaacgtcattccgaataccgagggcgagcgcaacctggcagtcctgctggatgccaaccgcaccggaaaggacaagtcgggcgctcgtgatgtcgtcggtctggtcgtggcgatgccggacggcagcaaaatcacctgcaccaacggcacccccatcgacggcgttctgatcaacgcggtggcaagcgtcggccgtctgaagaccaagccgtatcggttccgatttgaaaaagtgatcaaagccggtactagctgatgaagaaaattccgctgacagcagtccccaatcaagcgatctcatttaacgccggtagcagctattggaagattcgcctgtaccagaacatggacatgatgaatgccgatatcagccgcgacggcgtgatcgtttgccatggggtccgctgcttcggcgggattcctcttctccagtacagccatcagtaccgacctgactatggcaatttcgtcttcgaccgcgacgccgattggacgttgttcggcgacggaattaacctgttctatctggacggcgccgaattcgcagagtatcaggcgctcgccacgaggaaagaatgagcacatcaacgatcagaaccgggacgaacaatgatatccttttggacgacaatggaaacatggtcatcctcagggatgtcgaagcgtgcgcccaggacgttcgggcggcgatgctcatgcgcaccggcgaaaatattttcgatgtgaactccggcgtgggatatttcgaatacatcttctcgccgcagaaaagctatgatgacgctcgcaaatccatcgcggatgcaattttgtcctcgccggatgtgaccggcatcgagcagctggacatcgacatcaccggggaagtcttcggcgtcgatgctaaagtcatcaccatccacgggcctgttaccacaggagtttgaaatgagcacaatcagcatccaatacgccaacggcacccaactgttcctggacggcaaaaatccgccgcccctggacccgctgccctcgtttaacccgtctgtcgaagatctggaaggcctggaccgcgaaaagaacaccgacaagggcgactcctcgccggccggtcttcccgttcccccggtaaacgtcgattccaatgtcgacaacggcggaaccatcccggctccggtatcgaccgacgctcctgcggccgaatcggccccggaaggcgcccaggaagctcctgcagcgggccaaggcgacgagaaaggcgccgaggaagccccgactaccgccccagtagaaaaggccgaggaaacggcctcgccggccgctgaagaggcagccccggctcccgccaaggccacctctcgcaaaaccaccagcaagtaaggactcgacatgatcaacgtcagcggcttcggcacaggaattgtaatagtttccgcctcatcgttcccgatggggttttccttgtcgaagttcgctgatgatgagagtccgatatcctccaaagagctggagccgttcggatatgagatgctttatgacggtggcctattcgcctttgacaaggctgctcctctggaagtatctgtatccgtcatcgcagggagcgaggatgatattaaccttcgcatccttctcaattccaaaaagggatcattcagatttcttccgggaatcatcccggacatgacgactctcgtggccactcttcctgatggcggccgcaccgttctgtccaatgggactatcatcaagggtccggccatcgacaccatacagaacaccggacgacgcaaaggcaacacgtacacttttgttttcggtagctatcttggcgcccagactgcgcgtcaagccatttctaacgttatccaatcggtactggaggtggtctgatgttagggattttcaccagcctcctaagttcgcgatctttttcgattgtggaccaaaacacaaaccagctagttgctgcggatttgaggataagccgggtcaacacccggttttcttctgtagggcaacgccacatgctggaagatggcacgaccaagatggattccagaacgatccaccctatggaaatcatcgtcgaagtattttgcccttcaattgatgtcgtcgatcagatcaatcaattgctcctggatcgcgacacactgtacaaagtcatcactcgcggcatggcattcgaacggatgatgtgtaccagcgaagcgctcaatcagactccggatatgatatcggcgactcctgcgcggctgacattctcccaagttctcgtccagaatcccaagcctataatgttcagaaatgcaggggactcttctatgatcgaccgagggctggccctagctgaagacgtggttggctcggccggcgatctgttcgactacgcagtgaacggcgtccagaacgccgcagacttgttctgaggtgccaattgaactctttcctcaagtctattctcaacacgcctactctcaccatacgcgatgatgtcaccaaacttcctgtctggaagagtcttcaagtcaagaaagtggaaatttactcgccggcttccgtagtgtcgaaacctctggcgacgaaagaccagacggaagctcaagtgtacaccgaagctctggacattgatgtgaagaatggaaagatcatccaaccggtgcgactccgcatcaatgctatctgtccggacctgtccaccgttgaaagtatcatgaacgccttcaatgataacacctcgactttcgctatcacttctaagtcgatattggccgataaaatggccatcatggcgctcgatgtagatcagtctccagacatgttgaacgcggctgagatcaatatggaattcgagcaggttgagcctccagtattgaataaattcgatcctgcgttccctcaagatagtccgacttatggggtacagattcaatctctttctgatgctaatttgctggatttgggcgccatcggcgattcgatatcttcggccgcaaaatcgctatataatcgcgcgaccagctacttctgaggatgtatcatgcttgaaatcaatcttcccgatggccgtcaaactcgcgtacaaatcgaggcgtggtcggcattggatggctgggaactccagcgccgtttcgtcgaattcgctgtcagccaagattccgacttccgccgctctttcaccatggaaatcctgggctatgcgaaagtgctgcttggcgacgatgacaccggcattccgctgaccaccgcggcagtcatcaacaaccacctcggccactggaagaacgtggaactggttttcaactctgttctcaagcgcaatggcatcgacccggccacgcacgccgaccggccggactattgggaacaagtcggatcgcagatggccatcgcatttctggccgaggcgtccaagctcattggtccagcaatgaagatcgccgaaggactcgccaacaagccggagtgattcatgtctagtgatttggatgaattcatacttcggtatgaggccgatactgccagagccgagcgcaatctggagcgcctccagaaccagatcaggcgcgtgaacagcgcatcgacgagtggccttcaggatttgcgccacttcgcagacggcgcggccactgaactcggccgagtcgttccgcagatcgattctgtgacgagcgcgattcgcgggatgaacgcgcaactggcgataggcgccactggcgtggccctggtcgcggccggcgtcaaggcgttcatgaacaccagggaccagtacaatcagcagcgcatccaggcgatggacatcggcatcgccccggcacgcttggaagagtaccagagaaaattcgttcgccagtccggtggaaccatcagccgcgagcagggcgcggagatgaccaaaaatctggcagacactttccggcgtgcttatcgcgatatcgggcgagtcggcccggaagcgcgaattctgcgtatggccggcgttgatgtcgggagcttccaaaagggcatgcggccgctcaacgacatcattactgatctggccacgaaaatggccaagctgaagccggacgaaatttctgcctacgctgatgcccttggcgtctcgcgagactacctgagcaccctggctaagatcggcccggccatgggaaaagtcaccgagatgacgactgcggaactccagtccagggtccagggcgagtccaacattcagaaattcaacgatgctctggcgaatctcaaccagacgttcaccaccctggaaaaccgagtcggcgaaaagctcgcgcctgcgttcaccaagctgatcgaaatcatcgacaagatagtccaggctattcccaatgaagtggaaagcttcgcgaaggacaccaaatcccgttgggaagatggagtgctcgggaaggcgaccgttggcagtgatatcttatccctcctcagccccggcgccctgctcggtcgcctggcagcgtgggggactcgtcgcggcatggaagaatcagggctcatcgacaaggacaaggttcccggcgctcaaaccagcgaagacctggccaagaaacaagaagaccaggacaaggctactaagtccatgaaagagctagagaagctggctgaccagaccacgaagtctaccaatgattttgcggtggcgatcaacatgttcagtggcgcggtatcgtcgttcgcgaatgccgttgacgagcgccaagcttgggcagcctgggcgggggaaattggtcgggcggtcggtatgggaagcaccgcgccgacttcgcgggcaaccggcgtctatccgcacgcgatctatgatcagtcgaagagtggcgcggccggacaagtcttcggcgagccaatcggcgcccagtctcttcgcaatcgcatgttctcgccgcagcgcaaggccgaaccggtcaccgttccatcgtacatcaacgacatcatcaaagatgcgtcgaagatgtacaacattcctgagctggacatcaagaaactcatatacaccgaaagccgattcaacgccagggctaccagcgaagccggagcgaaaggcctcatgcagctgatgccggaaatcgccaaggcgtatggtataactgacgtatatgaccctcgccagaacatcctcggcggaacgcgtctattgcgggaaaacctggatcgagccaatggcgacatgcggctggccttgacctactatcacggcggcctcgatccgaagaactggggaccaaggactcgcgcatatccgggtttggtgatgagcgctccaatcgagctgatggaagaggcgcagcgcaagcagaaggctgcggccatgaccgccgccaacgagacgttcgctccggaaggcggcgacatgtacattcgcccctatgatggcggacgattggaaactccagaccagggcaagaaggaagatgagcgccgcgaagcccgtcgatatgacgacagggttgtgcgaccggaaattcgcatcatcgaccgcatgccagaccgcagcgacggcgaaatcctcaagatgtctagacgtcaagaggccgaccgggcagattctggattccggaagttcccgaatcaagttcgcggcgagaccaagcagaacatccaggctcaactcactgcaggagccatcgcgcaagtgatcggcgttaaccccaaccagatcatgcgccgcgaaatcagccgttctgacttgctgttcggatacaaccaagccatcctgggcaagcaacaggagatcaaggccgccgcgaccgaagccaacaacgtattcctgtctccagccaagcttgccgaagccacggccaaggtgaacgccgcatcgcgagaaatggatattctcaggacgtacggcgagcaacttctgaagagcgctccagagcgcggccaggagctgaccatcggtcggatcgacatgttggtcaacgtcaccggcgcgaattctccggaagaggctcgtgagatattcagcaagcagactgcagaccagctgactacggcaatccaggacgctcaaaacgattccgcaactaagatactctactgatgaaaaagagaattctgcgagtaacattcaacatgccttatggacccgaagtcatccgcgaagatctggatgttcgggtccggattatgaaggctgcgttgcggattcagaaccgggcgacgatggaaattttcggcctcaccactcagctgcgcgagtctcttctgtcgcagttcaccgcgtggaagcaccggcaacgtcaagtgggcagggaagatgaattgatgatcaaggtgtcggtggaagccggctactctgaccaggggcgcgagcaagtttccagagtctttgtcggcgaagttgccattgtcgatatcatttctccgccacctgacattggaatccgcatccagtgctataccaggcaaatcgacaggacgaagaccattcggaatatgccgcccgccaacacgacgtttgtcaagttcgtcgagtggggcgcgaacgaaatgggattgaacttcatctgcgataccagttacaacgatcaagttctgaagaatccgggccggtctatcactgtcgcgtcggcaatcctggcgtcgattcaggatatgtacatgccggacgtggccgcgttcgtcgatgatgacatattgatcgtgaaggaccgcgataaagtcattcgtccggatgaggtgaccaacgtcaactcgtttgttggaattccatcttggtctgaatggggcgtggaattccagtgtctgtttgagccatcgattcgtgtggctggaggcgtagcggtcgaatctctcatgaatccaagtgttaatggtaactatgtaataactgctctggaatacgatttggccagtcgggatcggccgttctatatcaaagtcatggggagtccagcagcataatggccagggaaatcaaatcattcaacatgttcggagttcactatacttcgcggcaattctctgctgtcgatgggctcagcatgatgtcggaaattcagaacgtgccgccagaagaattgctcaagggtactgatgtattggcgcatccggaagaccatccggaaggcatctggcttccattgactgctgcgaacatcaatctttatgtcgttgatcgagcgaaagtaatagctcccgtacaagttcttgcacttctgtccgaagtggtaatcgactggaactttggttttctcaaagactggaccggagtcaagattccatccagatttgtcgaagatatcaaaagcgtgaagacggcacattcaccttctgtagttgcgagcttggtcgcgaacggctcagcctctatgcgcgagttggaagagtattattcgactcaagatgcgtttaagatgatagatatcatgacggcgaagagcgtgaacgaggccttggcgtccgaagcatcgcacaacagaatcaaaaaggataattcctaaccgggcctgggaaggctatactagacctgccaaatcagaggctttcccatgtccaatatttctctaacatcagcaaaagctcccgacaggacgcgactgatcgccgctcttgacgctcggtcgcggcgggatgctctagatttcgaagtaatgataccggctcaggttgttcaatatgacagggccgagaatatcgcaacgattcaacctctcatcacctgggttgacacggaacacaacgccgtccaaaggcatcagctggttgatattcctgtaatttccatgggggctggcggattccacataagtttcccgattcagcaaggtgacataggctggatttatgcggccgaccgcgacacatctcagttcctggagtcgttgtcaatgtcgaagccgaacaccggccgcatccataagttcgagcatggcctgttcatcccggacgtattccgtcgatacaccatcaattccgaagattcggccgctatggtcatacaatcgacttccggagcgaccagaatttcgattcgcggcgataacatcaagataactgcgccgtcgaacgttactgtggatactccgcaggcgaacttcaccggcaatgtgactatcgctaacaccctggtcgtaaacggcatcaacgtgaacaaccacggccacctcgaaaacaacccgcctgatgcccggacgaaaggcggcatgattgcttaaggagattttcatggcaagttttgatttttctgatttaacagcgggggggggttgtaatggctaactacaactacatcgtcgatactggtgtgatagtcgcagataccgccgacgttctgagcgacgttgaggccgagttccgcgccgccctcggtgccaatatcaacttggccgcgagcactccgcagggatcgcttgtcgcggccgaggccatcgcccgttccagtgtcatgcggaatgaagcgcgaattgccaataccataaacccgaacgtttcattcggaacgttcctggacgcgatctgtgccttgatggggatcgagcgcggttctgatctgtcaaccttcggctatggagttcaagtcaccggccgcagccaaacccgcatttccaccgggtctagggtccagactccggccggcgcgatcttcacagtgatgagcgatgtcacgatccctgctggtggtgccgcgaccatcgatatcaaatcgcaggagtatggcaacattcctctgccggtcgggaatctcatcatcatcgacggaacaattggatggtccggagcaaaagtcatcgcctccactcgcgtcgatccgggcagccgccaaatgagcgatgcagagttgaagaatgcccgcgttaatcgattggccatccaaggccgcaactcgactatggccatcaaggcgtatgtgagcgccgttccaaacgtcacgtcggtgaacgtaatcgagaacaacaccggcgccgttcaagtggtgaatggagtctcgtttacccttccgtatgctgtttgggtctgcgtcgccggaaacccggataaacaagcagtcgccgatgcgttgtgggccgctcataacggcggaactccatgggactatggtgcgacgaacaacggcgtcccggtggacggtccgaatggcgttcctgtgcgcgatccggcgtccggtcgaaagtatgtcgtgaagtggaccgctccaattatgtacgatggatatgttaacgtaacagtccagcaaggttcctcctctgtagctccggaagccattcagaacgcagtggtcaattacgcccaggggaaagtggaaggggaagaggggctggtggttggcgcgagcctgtcggcattcgaagtcgccggcgccatcgctcgcgaaattcccggcatctacatcaaactctgccaggtcgcgtgcgtcgcggctggctcgccggctccggctccgggcgatttcacttcggaatacgtcatgagcgcattcggccaggctaccatttccgttggtaacgttcgggtgactttcgtatgactctgcctgcgtacaattcggacatccaacaagctctgaaatggctccataaccaggcgcctggaatcaccggcctgatccagagaaaggcgcaatggtatgacagattcagccgccaattctgggccaactgggagcgcgacgttttcaacttgaagaccgccaacccgttcggccttatggtttggtgcatcatcctcggcacgccttcgaaagggttcggcctttatccaaaaaacagttcttgggcattcggtcggctacgccagaacttcatctatagcggtacacaagtcccgccaccggcagacgcatcgcctggcggcaacttctacggtggcggcaatgccgaaattctcaacttggacgaaatcaggaaagtgcttcagctaagatatgtagcgctgatttcgaacggctcgattgcatatatcaatcgcatgcttcggtatatcttcaacgatgatgagccgtgggacgaggcggccgggttgtacttctacctcatggactcgaccggcgagaatggtcctgtggaggatttggccgtatatcggaaagattgggaagggatggttttattgtctagctcgcccaggacgaaccatgtgctgatatcgactcctgccagcgacgccgattggccaggagtcgatccggccgcgagcggaattccggtaacggtcgaaacggcgtccgctacggccccggacggctccgctacggtgtgcaagcttactaagccggccgggagtaccgcttacgtctccgcgccgatagatgggacgctggggtccggtagcactgtcacgttctcgttcttcgcgaaagccggctccacccgtttcattgcaattcagtcggctgccgatttccccagtcgagccgatgccgttttcgacctggattccgggaacgtaatcagcgatcagatgctggacagcagcgtggtaagcgcccgaatgattcgtctggaaaatggctggtggcgctgcgttctcacgaccaagaccgtcagctcttcgttccgcgcggcttacatcgctccggcagaaaccaacttcagctggattgattcgaattccagcgcggcgattgatgtgcttatctggggcgctcagatcgaactgggtgatgctccaaccggatacttggagactaccggaacgcccgtaaccatcaccgattacgttttgcagagcgcccagaccggaacggtcaagttcacacagcctcttccgaccggagtagaggcgtattggactggagactggaaaggtgggtctgcgaccgagccggccagattcgcagtaggggatgggactcaagatacattcaatctgtccagccctgcatacatcggcctacccactagtggggcgttcaagctagaatacagagttggtccggcgcttaatttgtcgccgcaattgatcaacctcatgaatgaccgggcggtcggtatcatgccgacttgcgccggttgcgatgtaaaagtcattcaggagtaatgacgtgatcacacccgaactgatacccagtccgtttgctgcgcagggcgacaaagacccgatcccgcaaacctcttccactggctttgccaaccttcgcgacggctacacgccggactacgaaatcagtctggcgtcgaacaacccgcaggccaaagcggtcgagcggaaaattcaaaaccaactcttcttcatcgcgacccagaacgcacaggcgtggcagcggcaaatggcgccgccgtggtttcagggcatgcctggcggctacgaacagaatgcagaagtcgtgcgagtcggcaatgacggcataatgcggcgttatcgttccatggtgaatgccaacgcgagcgaccctctcagcagcacgacttgggaagaacaacccgcatggtcggtgatgcgctccaacataccgatgccagctggaggcccaggcctatcttctggcggagaagtcatcacgaccggccgcaacttcaatgacctgttgaatgggacgtgggagttcttctctgattcagtggtcgtcgcttctcagaacgcccccgtatatcccgcttcggctggtgcagcagctggaatgttggaggcgaaatcctggatatccgggtccaatacattctgcgttcaacgctacactgatcgcgtcgggaacgtcgctgtgcgcgggcttaatgccggggcctggaccaactggatgtacgcagtaaatgtcatggccctccaacaaggtcgggtcacctatggagtcgcggccggatcggcgaacgcttacacgttgacgctagttccgcagctccaaggcggcctggtggatggcatgattcttcgggtcaagttcaacaccatgaacaccggcgcctccaccatcaacgtctccggactcggcgccaaagccatcgtcggcgcggccaacttccctctcaccggcggcgaacttggccaaggactcatcgctgagcttgtattcgacgcagcaggcgaccgctggagaatcctcgcaggcgcgccacgcatccaagttggcaacgccgatcaagattaccaggcccccagctggaaacaggtgaaggattacgtcgcgtcccaaaagctgactgaagtggactgggctgacgtcgtcaacaagccgaacgtcgctatccaagacaccacgccgtggttcgccaatctggagctgtccgatgctcggcctttcatcgatttccacttcaacagcaatcgcgccaaagacttcgactatcggctgatatccgaagcggacggatcgctggctttctattcgcggcagggatctgctgggcctacccaggacatcctgttcaaccgaaattccgtgactttcttccagccgcgactcgatgtggcgaaaaacctcgcgtacatcgcgaactctggccccctttggcagaacaccaccgccgatcagcccggttggaaattcacctttgcacaaggcgtggacgcgaacaacaacgcggtgatcgcagtcaataccaccaatccggacggttcctatcgttcacaggtcatgcgatgggactgggcgtccacgaacgtcatattcaacaaccgtccgctcttcgccggtcaatacaccccttgggattctgggaacttcgatccttccaccaagttgacggtgaatgccgtgaaccaaatcgccggcccaaccgggattcggaataccaacggcaacaccggcaacatgaacacctggggttccggctccacgacggcatcctatggcaatgctgccattcaaatcttcggaaaagggggcggtgagcctgccgcgatctatttcgacaactcccagaccggatggtatctgggcatggacaaggatggacagctcaagcgggccggctggtcgctcggcaataactcctatgtgatcaccgacgaatccaacatccgaacccatatcaacacaatggctgcgcgcccgatttgggggaatgtcgagttctggggtccgtggaacttcgatccgaatcttaaactcactttgaacgctttcaatgatagctcatacaccaggatgaccaacagcggcgcgaaagacgttggtatcgcgtccatgacgagttatgctgatgcggccatgtcattcttcaactatgaagcctcgaatccgaccgggccgcgcgcggccgttatttcgttcgtgagaaatggatcgcgtggagtgctattcggcttggattctgacaacaagctgaagtggggcggatattccctaggggccgtcgcgttcgagattgccgactccaacaacctcatgagcctgtggtcatcccacgctgccgcgccgaactggaacgggcagaccatctggaggtcgggaaacttcaacccagacaccaaggcgactttggcagctcgcaatacgacgtcatcccctacaatattcagttatggggcgtccggaatcgcatcaaccggacaggtcggtgcgttggttgtggaaaacaacagcgtcaccaataccgcagccgccatcacgttccattcgccgcaaaaatatcaggtcaacttcggcctggatgcggacaacgtggtaaagatcggtggcggcacaatgggcggcgtagcatatcccatcatccacgccgggaactacaataactacatcaaccaggcgctggttcaggtgggtcttggcggagtcggttcctatgcgatccttgcagtatttgacacctccgcgccggcagcgtccattgcccccggaacgatcatggacagttccaagctgttctattcgtcctgcgattcgacctatcgcagcagcgccagtccgacgggcacctggcgctgcatggggtatgtgtataaccgagactccaccaacggcgactcggcatccctattccagcgggtaacgtaacatgaaatggacgcggatcagaaaccctcgttggctggatgaaacaaacatccacgccatggtgactttcgatgggatcggggaagttcctttcaccgccaatccgcacgacgtggaggcccacggaagggccatccacgctgcgatcctatccggggcgcacggatctatcgccccggtcgatgcgaagcgggagcaggccttgcaggacgctatacgggccagggaaaagcgggctatccttcgtgatacccgctggcccatagatcgtcacgacgagcagaggcggctgggtatcgaaaccacggacggacctgggttgatagcagcccttgttcactggaggcagcagattcgcgattggaatagcggggatcggccgcgacttcccatggctctgaaaacgatgttcaaaaatcaggagtattgatgaaaatcacgaaggatgttctgatcaccgggaccgggtgcaccacggatcgggcgatcaagtggctggatgatgtacaggcggccatggacaagttccacatcgagtcaccgcgagccatcgcggcctacctcgccaacatcggcgtcgagtccggcggactggtaagtctggtggagaatctcaactacagcgcccaagggttggccaacacctggccgcgccggtacgcagtagacccgcgagtccgcccgtatgtcccgaatgctctggcgaaccgcctggcccgtaacccggttgccatcgccaacaacgtgtacgcggatcgtatgggcaatggctgtgagcaggatggtgacggttggaagtatcgcgggcgcggcctgatccagctgaccgggaagtcgaactattcactgttcgccgaagactccggcatggacgttctggagaaaccggagcttctggaaactccggccggcgcgtcgatgtcttcggcctggttcttctggcgcaatcgctgtatccccatggcggagtccaacaacttctccctggtcgtgaaaaccatcaacggcgccgcgcctaacgatgcgaaccacggccagctccggatcaaccgctatatgaagaccatcgccgcgatcaatcaaggctcctgacattccacccaaagaaaaggccgcttattcagcggcctttttgctttctggctttgcctcttcaaccatcttgatctcgaccggcgcggcggactcctcctgagttaccgaatccacatagttccctagtgaactcagaacgccgattaacagcgctcttactaccttgtccttgactgtctcgcctatgatcttggtcagaacggatatcaactcttcccggagtcttgggctgattcttggccgaaagcgcttgcgatgctctttgcgtttcatgtttagtcctctgtctgcggtcttctcctcaccccgataatggcttggggatgcgctgtgttagtcggaagggtcgggcgctattataacccgtcgaaaatgctcgcgcttaactgtttaacgatacgcaccgcgatactaaatcgccttctttctggccaaggaactctggcggcctggtccggtctaaggcctaatttgtcgacattaaaacgagaaaacccggatcgcctgtaggacaaggcgtccgggtttatttcgatctagtgtacgctagaatcagtggcttccgccccaaccgtccagccagcaatcgaagacggcgtgtctaggcttgtccttggcgccatgggagaagtgcttgaaccggatgacctggcccttgagatactccctgtcattccagcggcgctgtttctcgtcgtgggtcaggctggaggccgacacgttgaaggtgactccaggccacagacgttcgttgcggcagacgaacgcaccgaccattccggacggcgacaggttttctgcgtggctggagcgggccgtgtggccaagttcattgatgaaagcttcattgttgttgtgcatcaactcttccacgtcgatgatctcagcttcatcgtagtcgtatcgcttgactttcacacagtgcccttccttggcagtcgagcgaccgaacttgtacagtccatcagcgcgcttgcccatggacccttcgaatcccagcatcgtgtggcggcgctcgacttcgctgaactgttcgatggaagtcaccagttcctgctctaccaggtgaatcctctcatagccgaggcagttacgcaggaagttcacgcgctcggccgccctggctaggcgatcttcggtcggtgcgcgaggatcggtgaaatcatcgaacacatggaaagaccagtccggctcaccgctgtggcggcgaagatcgccggacgacttctggaaaactttcgggtcgctgatgtcgccgcagaccagctcgccgtccaggccgttgaacagtttatcgctgaggtattcgtagatcgattgattgttctgccgcttgagttgacgagtcagcgcctcgccttcgaatacgaagcagcgaaatccatcgatcttcggtgagaaatacatcggcagttggccttcaagcagcttcgggtcaaaattcgatgcgagcatgggtttcatacagttctccagaaaagaagcccggcgaaccgggctaaatggcggtaagccggctcagatggtttcgttggcgtggttcagttcggccacgatcgacgcatagcgctcgtccgactccttgatgaacacgccgtcgtacatgacgcctttgcgatccttgatggtgtcgtaggccgcagcgtagcaggcgagcatggtagtgtcgtgctcttccgtcacatcgaacagagtcatgacggccaagaccaggctcttgatggctaatccatgatttccgcgtgccagcgcgccggccagatgtccgaggtgctgcaaatcgtcgccgtaggtgggatgaacttcgacagtctcgctgaagaccgatagatgatcgaacagattttcaccgagttgcgcggccatgaccgtggcaaccaccattacgtcgccgatgccgtctttcacctcgactggtttgttataaacccaggcttcgcaaacttctgcgaactcttcgaccaacttcaggaattgatccttggccgaagagcctttgatcaggttccggtcggaaccccatttaacaaccaggtcgtgaagttcgcgactcatgatttgttcgatattcattctttcgattccttttggatttgggatttgactgcgttgattatggacgccgtgctctggcgcgatccatccttggtggtgccgaagtagaaggccatgaccgacttcagctcggcgaaccaatagccgatgatggtgccgatggcgacagaggatgtcgggtccatcagagcctcgcggccgaaggtgaagattgcgatgatgatgagaatggagcccgtcagaagagcgaatgtaatcgccgggcgaacgaaatcgttctgctgcgcggcaagcctcctcgccgaatccctgtctgccgcctctgcggcgaactggctaagctcggcctggagctgattctgctcagactgaaggcgattttgttcggcttgaatcgcaagctcctggagacgaacgcgctcggcgctctggagttcggcgaggcgcgctagagcttccggattcgcgtctagagcgctagcgaccgaggctgggtcggccttcgaccccagcgccgtcgcgacgatagcgccaacggcggcgcctgcaggcccacccaggagcgaccccagagccggggcagccgcgccgatcttactacctatgtctttccagtccatttcgactcctcaaaagaaaggcgccattacagcgcctttctccggccggtgatttagaactcttcggcttcggtcgcatcgccgacgccaccggcgtcactgcgaggctgttcctgcttgctgtagtccaccttcacctcgccgcctacgaacgacttgtacaggtcggccgcagccttgaagtgatccgggttcttcaccaggccttccagctcgaactggacgccggaccagctgcccttgtcgttcgacatgcctacggtggtcatacggaccaggttggcgaaagtcggcggggtgcgcaggccctgcggggtctgaacctttttctgggacagcgcggtcatgagcttcttcgaggccttgatctgcgaagacgacagggagatcagagcctggccgaaatcgccggtgtccggatcgatgacgatgacgtaatgaccacgggtgtcggcgaagtagtcagacttcttgtcgctgaccgaaccgtcttcgttcggcgcgtacaggcgtccttcgacttccttcaccttggtcgggtctttcatcatttccttgaagtcttcgacgctgatggcacccttgaaaccgccctcggcctcgcgaccggcccagcggatgaactcgcggcggtacgcggccggaatgatcagcaggccggtcttgccgtcgtaaaccttgccggtgacggtgttcaggaacatgccggccttcgcgccttcgatgtacttcgggtcatcttcatcgacctggggagacatcttctgcaaaacctggatgaaggggatggcataggactcggcatcggcgccttcgaagcctgcgccgtcatacgatcccaaatccatgaagtcgggaacttcggtagtcgcgacggcgccgccaccggtggcaattgctacggccttggtttcttcggttgcttcggaagtttcggttttcttaccagccatgttaggctccttgtttgtcgaatttcagttatcgctaactgtgggtttataataacggaagttgcaactaagtaaagcaaattacatatcaagatttgctctttttcaccttcggtttcgtgatcttggcctctttgtattcgtgtacgccgatgaaatctggcagctcttcgcccttctccaggtactcgcgaccgaacgcctggagggtctggtaatggacatcgcggttgatggtggcgtcatagccggcttcgatgatggcctcggccgccttcttcgcatcttccatttcgccgcgaccgaattcggccagaaccttggtcttgatgatgccgtcgttgtcggtgtcttccagccacttccagaacttcgatttgttctcttccttgacggaaatgatggccttcggctctacttttacagtgcgaccgtccgccagagtagtggtcttctgaccaagctcctccaacagctccggaatggtgttacgcttgagggtcttcagctcctcttccttttcggccagcgccttttgaagatcgaggatttcgccgtccagctgcgaagccttgtccaccaagttcagcagtcgatggccgatgtcggtggcttccaccgccatttcatccatgacgccaaaatagtcgatttcgcccggcgcgttctctttcaagtattccgggatttcaagctcttgctctttcatgtccgcctccaacttagtgatgttcccttacttgaaccaagtattgagtagatattatgccgcatcttccttgatacggctactgatttacatattaaatttcgtcgcgagtgctaacgtcagcctcaaacacgccatcaacgacataacttgccaggttgcgtttccactccaagctgacctggattttctcgtcgatggaatccagacagatcaggtcgaagtacagaaccgagttgacggtgccgattcgatgatttcggtcttcggactgcatccgcagctcgttgtcttcgtcggtcgtgtagtagatggccacgtctgcggctgtgagcgtgatcccgatccctgctgcggccgggttgcccaggaacacctggacgcgcttggcctggaaatcgtcgatcaatttttcccgctcggcctctttggtctcgccgtagtaggtgccaaacgaaatcccttgggcctccaaatacgccttgatctggtcgatttcctgaatgcgcatggcccagacgatgatggaacgctccgggtcttcctccagcagaccctccagaagatcagtaaacacggcgaatcgcgggttgtcttcgggcggcaggatcaccggctcaccatagacgttgatatagccggacgccacttgcttgagcttcgagcgcgctgccgcagcatcgaaagatacatccagcatgaaatcttcgttctggagaacgaagtgatagtcttcttccacgcgctgataaacctttcgttgctccggcgacatttcgaagtatatgcgcttgtacaccttgtccggcaggaatggcaatgcttccttcttcgtgacccggaagctgtgcggctcgatcagggatcgcagcttgtccaggttccggaataccgggcgcccataatcgtctttttcgacgagttgcggcggcatggtttgcttcccttccagcttgcgcatgatagcgatcattcgaggatcgtcactgggcaccaagacggaaaattcggccacaaacgcccgataggatttagtccccagaattccattccgcaagaattggaactgcatgaacaaatcggtcggcgcccgcgtcagaggagttccggaaaggatgcgacgggccacggccttctcgcccagctttacgatctttttcgcacgcttggcttgtgggtttttgatcctcgttgactcgtccacaattgcgcaaactttgaatgtatcaaggaatcgctcgacctcatcatagccagcctggtggttgattgcgtcaacgttgatggcgaagacgcgaagaactttttcatctgcgaacgtctcggaatacagacggtccaagcgcgccctggcctttttggaagtcggtcggccgcgccaatccacgctcaaagtcttgatcgcgacgtgggtgggaatctcgcgcagaatccagttggtgtggacgcctttgggggcgacgatgagcagcgcgtccacgcgcccctgtaggaagaggcgaacggcatcggccaaagtcgtccaagtcttcccggtgccctgctccatcaggtatgcgaagttccgtttgttcagggacgctgccagggcattgaattggtgctgcatggcctcggtcttcatgcccttgacgggatatgttttggctttcatttgttctccaaatcggcgaggaactgaacaatgttatccagtccttctgcatagctcgcaacttccaccaagtcgcggctgttaagctcgaacaaatcgaacataggattcagcagcagccaatcggttccgatcttggccaggacgaagccccggccaccccagccgatccgctcccgaagaaaagggatttgcccaggttcgaaacatctggccattgggcaggtggaagcgcgtttcggccactcctccaaagccttgaactcgacccagaactggacacctcgacgattcaggcagatcgaatcggacatgccagaccgccgcgtctccagaaagtcgatcaggattcggccgagcgagcgctgcttaaacgcattcgccgctttcgtttcgcgatcattcatcaccttcgccctctttggaaactttctctgcttgtgctgccaactttgacttctcgcgctcggtcaatatccgcttgacggccttcacgatgaacatgtcgatgccgctgagcctccatcctttgatcaggaaccaagcgccggtcggcgtcccttcagcaatctgctttccgtattgcagatatttttcaggccgaattctgaaacgtatcggctgatcaaccgagtcatcaacgcacatgatgtcgagaaactgcgactggcccttgtacaccgggtttttcccttgatcagccctcttcttctggcgaatcggttcgttctcatcagacagaacttttttcaccatcttgacaatgaccagaccatcatctccatcgcggatatcccgaatgttctgaatggggtttccggaagttactccaaccagctccggattgtcataagcatgaccccagagcgtgtgagcttcgttcaaatctgcgaattgaacttcagaattcgacagactcgcggcgactttctcccaatcctgaagcgtcttcaggtgggtgcctgccagctctttatattgagccttcagctccttaagatcggccttcaactccttcagatcggccttcaacagtttctccagttctttgtcttggctgattttcgccgaaagaatctgggcttccagagctgctacatcagcagccttgtcctcaacatcctgtgccgatatcgggcaattggccagggcgatcctcgcggccttgacttcctcacgaagacgcaggaaccgctcggccttcgccgggccgaagcctttggcgttcatgatgccgccgatcaggcgcccgtccgccaccacccagttgagttcggaatgctccgggtccagggccgtatattctacgccttctttggccaattcgcgaaggatagacacagtttgctggtcgtccttcgccgcccgaaggcacgcggccgcgtattccaggcgatgataccgcttcatgtagcaagtccagtatgtcaccacggcatagcttaccgagtgggagcggttgaatccccaggcgccgaatgtcaccatttcctgccaaactcggtgagcgtcttccggggcgacgcctatggtcttggcgccctcgatgaacaattcccggcgcttgttgaaaaattcttcgccctttcgcgccgacatcgctttccggatcgccgacgtttgttcccagtcgaactgaccaatgtccttaacaattgacatgatctgttcttggtacaggaacacgccatacgtccccgacaaatactgctcgacctgcggaatggtataggtcacaggctcgcggccggccacgcgctcgatatacttggttgccataccagaagacaacggacccggacgggcgagcgccgtgatgtggtcgatgttctcgaacgcggtgatgttgatcgcgtttgctaccgagcgaacggcctgcccttcgaactggaagatgccggacattttgtcttcattgagaatgtccagaaccgccttgtcgttcaaaggcaagtcgtacaactcttgcgcggtcacgcagttcgcgtcctggatgactcccaaagttcgaagtccaagcgcgtcaattttgaggagattcagatattccgaatcgggcttgtcgagctgcgcaacgccttcggaagtcaccgtacagaagtcgatgacttcatcgttgcagaccaggatgcctgccgcgtggacgccagagtgggatgggtgaatttcgaggtcgcccatgcaggcggacgcgatctcatacttttcgcggaagtcgcggccgggctgagttttttcgaaagtgtcctccaatccttttccatatcgttcgtccgccgatgtatattcgatgatcgagtttttgatgttgtcggtgtcgtggaatggaatgccgaagcgttttccgacgtgagcgataaccgacgcggccttgagtgtgttgatgttacccaacttcacaacgttccaagtgccatacttctgctggagatattcgaacactagatagcgatgggtatcggcgaagtcgatatctatatcgggaagatcggaccgggaaatgtcgataaagcgctgaaagaggaggcgatgcgggagcgggtcaacctctgtaatgccaaggagatagcagaccaaagagccggccgaagagccgcgagctggaccgacaagcatgtgcttcttggcaaacgcgaccagatctgccacgaccaggaagtagctgtcgaaatctttcagctgaatctgcttgatctcttcttggaatcgatcctcatactcctgggtccattccttgatgtggccgcgactgaggcggtaggcttgcccctcgcgagccagagcgacgatatcaccatccaagtggatcatcggcgccttcgccagtttcacatccgccaaccgctcgactaccgcacgagtattggctgcggcagtatcgaactcttcgcgagtcatgatgtggcgtaaacggctccacagctcctcttcggtggcgatgtggcgaaggccgaccgattcccgcaccttccaggccgacgcgaaatcagcatggtcgatggatggcatgtcgttgtaagaggtaattaccaccggctttccgaatgccctggccgtctccatagcgccgtgcgcggcgaccatcgacgcgggattgatgtcaatgtagtcgattccggccagatccagatgggcataggcctcgccagcgaatttgatgacgccgtcagcttcctggaattcttgcggagtcaatccttgattctggaccgacttggaagtcaagcggtagaacttcttggtgtccttggcgagcacccaggctttgagcttcaactctttctcgccatcgtcggcgcatttgatcgggatttccatgccgaatccgcgaggcagttctgccttggcagcggcttgttcccaacggacgtggccccatgttccgtcatcgacgatggcgacgaatggggattcgatctctttggcgcgctcgatgatctccgggaatcgaccatatgcggcgccgtaggagtaaccagagcgaacgcggagctgagggaaagacatcatgcggcctccattgcttgatacgcccgatacactcccatgcgcttgcagacttcgtggagcagccgcacgtcgtcgagcgcccggtgtttctgtacatatgggccgcagtagtgctcataaagatgttgcaaccgcatgcggtggccgaacaacggcgccgactcttccacagtacagatatcgagtgatgggaagttgacttcttccaggccgagctttccgcgagccaaatcgcaggtaagcatgaacttatcgaatggcaggttgtgggcaatattcgcgtcggctctggaaaagaagtcgcgaactttctggcgctgatcgaggaaagatgggtgcttgaccaggtcttcgttcttcaacccggtgatcttggtgatgatttcctcgataacgattccaggattgcagatgaactctacttcatccaaaatcttttcgccatcagttatcacgccggcgaattcgatgattctcggctgctttctcagactcaccctttggtggaacgggagccctgtggtctcagtatcccatacagcgaatatcatgtttgttccctcttatgtcgaaaggccggctgctttcgcgaccggcctgaggagtataccgcgacggctgaagatttacgccttctgtccgtctttcggcgtgatgcggccggagcgcatggtggcgtgaacaaacgccgaatagttgatcgagtccaaggccgaatcggcatccttgaacccgctattcgccaggcgagtgagtttgcccaccatgtgcatcacgaacagggcgagtcgatggtcatcggcggttttcgccaccaggccgttcgggaagaggatttccatgatctttccgtacatcagatcattgcgaccataggtgctctggcggtcgcggaagacttctgctgcggcgtacagattgttgagaacatcttccgcgaaatcatctggatgggaatcatcttcgcccggccagacggattccatggcgaacggcgcggcgtcttcggtcgggtcttcggactgagccgtttcagcgagcggagacggggctttcgcaaacgcctcgtcgagggtaggggcggagttcggggcggccgggaacggctcgcctgccatgtcgttgggcgcgctatcggggtcgctatcggccgcgacggcgaagaacggcgcatcgcaaccttccaggttcaggatgtaggagtcgatccccaggctattgtaggcatcgatgatgtcctggcgatcatcgaacgccgcgacgatcttggtgacgccttcgattttcttcagtatgtcgagcgcgactgcccgcttgaactgaggcgccggctcggtgttaccatacggccgcatgatgagttcatactcgcgatgttcggcgatgccgagttcgcggtggagcttggccctggtctggaaaaagtggttgtcggttcggccggtgacgaagaaaatcatgaggtcggcgtcgatggcattcctgatgcgacctacagcgtgcgggttgagagtgtccttgtcgagacgagaatgatactcgtcccattgccgttccaaggcgaagctcttgcggtggctatcgtcgaatacgcagccgtccaggtcgaagatgatgatgccattctttggtttgcgttccatattcagatttccttactggttgctttctgggtgacggttttatcgatgaacgtcccatcagaagtgaggcggaaaacttcgccattctggatgaaatcgaacgattgcacgttcatcgtgatgcgaatggattcgctgccgttggtcacttcgacttgtgcgatgtcgccaactttctcgacaatgatcttcatgttacatggacttcccattgacggccacagggttggcctcttgtttttccgatccccagaaatcgcggcgcagttcttcctgctcggccgagcgatccatccaggggcgatagaacttgcactggtagataggttccaacggaacatcaatcacaggaatctgacctggctttgtctccagagcggccatgaaccggtcataggatttctgctggatttcctcttcattcatcaccttcgacccatagcgcgggaaggcgcaggagccggtggcgacgcagtgcggctggagcaggctgtcgaacataggatagacttccagaaccagccggcgcatttcgcggaatacttcctgatattcaccctgggtccgaacgcacaggcgaaccttcgccatgtcgctgagagtccgcagattgaacttggccgcgatcttcgtttccatgttggaagggatgatggcacgagcgtcctggagcgacgcgccggcctccagaagcttctggtagctggtttgcgcgtcggcaatggcgtcatgccacagacggttcagctcttcgcggacatggtaggtcgggtcaggctcgccatttaccgtagccggttcgtcgaattcccagcggaaggcttccggctgaacgacggcgctgatttccagagcgcgactggtttcctgctggtaagccccggtacgagtccgaacgagttgatgggtgaagttcttgctgacaccctcgatctggaaaatgaagtccacgaactcgaacggcgagcggatggtgtccagcatgtacttccagtggtcaagcttttcggcctcggtcatggtcgccgggtcttggccgcgcatgcgagtggatttcgtccccaggagaagttcccaggcgttctgggtgtaactgatcagagaaattttcatcagaaatcttccggaattggcgtgaagtggaattttttggttagagccagggccaggccttgggcttgctctttacgaatgccatactgctctatctcttccttgagcagttcgcaggcctccagacgcgactcatactcttcagcctcctgaacggatgagaaaacggttccatcagaggttctgtacacaagttcaatcgacatgatgacctcagtagcagcggatgatttcggcgcggatatctcgacggtcgaggtagtgctcacgaatcttatcgcgggcgcgctcggcctcttctcgactgccgaacgacaggttgaacgaagtgaaaggcttatcgtccaggcgcccatcgccaatcaggtacaggatgcctaccagcacgaaagacggcgctgtctgtcgcgtttgcggcgggtcgatttgcatttcgaggaaagacatgggaacctcttcaggatgatctggtgcgtacattaatagcgctcctgctgagcagctacggtttccggctcatagatgagcatgtcaacgatttccgggcactggcctttcacccagtcgatggccgcgaccagtgtggtggaagcggagaaagagaaagtgcggtaagactcatggatgtacggcgaccccatcgaatcgcgctcggtcgtgcgagaaatgactgctttgatattaacgatccggcccatcttcggcctccactttagcgattatatctgacaggctcagtttctcgccattcaggaaataactggcgcgaaacttcctgtcaccctctggcccgacgatccgggccgttatggtgagactcccgccgccaagggcatcggtgtccctgaagaaagccagcagcgcccgcttgagcgctgcctcgcgaggatcgacggccattaacctaccacgttccagccgtgctgagcgcaccaaaccgcaccggcccctgcaggaaggctattcagaaggaacacaggagtcaggcgaccgtcctcggtcatatgtatgaagtagcgggcgccttcaccgagccactcggccttggcgatagcgcgttcgagattggccttggtggcgtaggttttggtgtggttcttgtcggtggagaaggttacttcgcgggccatttgtagattccttttggttgaagggtttcgcgtttcgatgagggaatattacgcccacctgatccagaagtaaagcacttttgtaaattacttcacgaacattttcttggccttctgataagacgaagaagtcatcaggcgctcgatgacgtccatgtccgaaaccagatcatccagaaggacgttgcgccaggtagcgaaccggccgagcgagaagatgccagcctcatgggtgagattccagatcatggattcgcgctcgtcgcgaccgagcggaatgattttgcctttggtctggatggtcggctcgccatcttcgatgagctgtttccttctgatgccgaaggccgcgcaaacgtaatccatatcccagtcgctgtcccattcgatggtttcgattttaccatctaaagtctccactatccctttagtgatggattcgacgatcagagtatcaccggtgatggacgctcgaaacgttcccactttaggaccagggaaatacacggtctggaagacatcacaggggatggagagcttgtatcgactcacgatgatggaggttccttcaccgaatgacgggtcgattcccaggtccagccctgccgcagccagattggcgcggaacggcgcggtgctgatgatattcacgtggtcatcttgccggcgaagatactggaagaaagaggcgtcgaaaggacggctccaagtgatacgattcgcaagcttagccaccagctgctcatagtagtcggccggtgcgatccaacgcttttcagtcgccagattccagatggaccggtccgacaggccgcccgttactttcctggagtacatgttgcagtggtcgatgcgcggctgggaaatgaactcgccatcaatgtagatggccttgtgtacggtgacttcgcggaatgggatgccggtgagttggccgatgactggtgagcggaaccgcaagagcgcgttgtggcgttccttgctcgtcggcgtcgccgcgtcgatgatttgggcttgaggaaagcgatgcgcggcgatcaggccggcgagtccggctcctacgatgattactttctgatcaggaatcatgatgtgtcccttatgagtgtacaaaacttgagaggataaaaaagggacccattttcatgagtcccttgaagagctagacgattcaggctcagaggagcggcggcttactcctcctcaccttcggaaccatcggcgccctgatcttcaccgccgtgctcctggccttcgtcatcggccttctcgtcatcgccctggccagcttcgtcttccttcgaagcgatggcaaccagatcgacccagcccatgatttccagcttgctcaggtagctgcggaccgaggtgccatagagaagatgggccaccttatcgccgaaggattcgatttcgaccggctcaccaacggtgcagtgctcgttgatgtgtgcgaacaccttgccgcgagtcgagaaggcctgcggagtgccatggccgtcgccggtcgggatgaagtgagttgcgcgggggcgacgcgagccgttggacttcaggtcttcgcggcgggcttcggccttcttgcggcgctcttcctgctcttccttgcggcgctgcttctcggcttcgcgctctgccttcttctgctcggccaggcgcttgcgctcttcttcgcgtgcggctttctgggcttcctgcgcggccttcttctcttcggccttcttggcgcgctcggcttccttctcggccttcttctgctcgcgctcggcttccttcgccttcgccttctcggcctgctcagcttccttcgccttggccttttcagcgcgctcggcttccttggcggcggccttttccttcgccttctcggcgcgctcggcttctttcttctcgcgctcggctttgcgcttctcttcgcgctcggctttcttctgctcggcttccttggccttggcttcggccttctcggcgcgctcgcgctctttacgttggcgctcagcggccttctcggccttgcgcagggcagcggcttgttccttggtcagctcttcgccttgggcctgttcgttctggttcttctgttccatgttcttactccgggaatgtttaaagggatggcttattggcctgtgaggggattatctctaaactaattgaagaagggaatacccttagcctgaactttcctaaatattttctttcgggaaagtccaaactctagggaacttatttatgttcgagaagttcctagcttttacgcaagaacagtaagtattcaattgcacgagtgatcccagtatacatcaactgactataagggatggacggcaagttctcttccaacatggcgactcgtttccactccgacccctgcgacttgtggaacgtcatcgcccatccgaagtcgaatccgccaatagccttctgcgcctccagccgcacgtcttcctcggccgaaaagctcaagggattgaacttcacccagcgctcatagttcgtgccgataatgcgaactttggcaaacagcatttcatccggctcgtcatcatcttcttggccttcggggaccggcttgaagtccagcagaatcgcttgctcgccgttcatgatgccatattcgtgctggttcccggtgcacaccagcttctcgccgatttccggttgtacacctttgtagccgaggatgcggcgcgccctggcgttcaagcggcggcgagtattgttgtaggcgcaaaggatcacgccatcgtcatccaggaacgtccgcatttcgtcgtccgacatatcgaagccagcccggactaggatatcatcatactcgcgacagggcaggcgtttgccctggcggacgaacatcgacgctcgaacgatattcccggcgttacgctcgatttcagtcatgactgtgtcgcagctatgttcgtggaaaacctgaacgccgcgcacagggggaacttggccaaagtcgccgatctccagaaccggaattcgatgcgccaacaagcgctcttcatcccactcaccggtcattgacgcctcgtcgagcacgaccaacttcggcttctcgtcgagcgagtctttattggcgaacatgatttcgccgtcttcatcctcgccaatcggccgatagatgaagctgtggagggtccgggcattggtgcaacccttctcgcgaagccgcgctgctgccttcccggttggcgcgacgaagaccgtccagtccatcgagcagcaaagttcggcgatgatcttcgcgatggaagtcttgccagttccggcgaaaccagcgagtcgatagacctggcggcggtgcgctcgatcacaccaaccgcgataccagtccacaacggaattgatcgcgtcgatctgctgactgtttggtcgaaagccgaatcgctcttcgatctgatcgacggtgaagttagatgctgacatatttgcgttctccaacgctaggtttaattgaatcgaggctcagtttaagcacgccgtccacagaccagccagtatcacgacgatacttgcggccttgcggatcgacatagaagttcttcgtgcgccgcagcagaacataatgccaagcagctccaagcgcgtggacccttcctttatacgggaaagccttcgcctgctctgcggcctctttggccccagggagccagcggacggtcgaaaggaccaggaccgcacccttaatagcctgggaagcggcgcggccgtcctgtgggctatagcgatgtctatcgaagtctacccagtggtggttgccgcgccggagcttgaccgttcgggatcgcccctcgaacaccaccgtgccttcgtgagtaaaaatatgttccgccatcgaatgttcctttataacgtacagttatgctttacctctgcgcaggaagagtatactatcagctgactcgccaaagcgagcgaatttaatccaactttacttcggcaggaaagtggccgatactagcgccgccgcctgtactgccctccaaaacagaggatacattaaatgcaagaatgcaagatttcccgcgaccaactcccggtcggtaatccgaatcccaatgtcgacaagacccgcgacccgaacctgaagcccggtttcctgcgccgcagccgcgagctggacccggcgctggcagttcgcattcgtcgcgagctgatccacgccgaagcgtccgacttggccaaggccggatgggtcaattcacagtccagcctctatggatcgaaagccttcccgcgccattctgtagttcgcgtgaccggagttccggaagatggagctttcatcggcatgctgatcggcttcatcgagcaccgcgagcatggcgaatgggcggtcatggaagccggaacgaaagaaggcggcgccgtcatcattccagtcgatcacatcatgcgagcgtcattcgccgaagccgaagagttcgccgaaaagtgggagcggaacttggggtggcgtctcctgcgccagctccgcgagtgcggcgccctggccgggactgaagacgagttcctgcggcggatcatcaatcgatacgttcgtgatcgcacgatcctcgatcaccacaaagtcggcgcggacaaagactacactgatgcagtactcaaaagcatcggcgaaacatggccgaaaattccttcggggaaattcgtcggacaccgagtcgcgcagctcctgatcggccacaagctaggtcgagcggggaccattctgaatgacctggtggacttcctggagaagttcgcggccgggcgcgataaaattctcaacatcgccatctgtaattgaggtgaatgaaatggttgacttggaaaagctgagtccaaagctgagtcctcggcagcatgccgttctactggagatgtacaggcatcctgagcatccagttcacagatcgccaacgaatttaactcttaaggctttgagacgaagggggcttgtcgagctatcctggaaggattccgtggctggatatatgttcggtcgccaaccttgctggaaaataactgatgccggcataaggcgaatcctgggagtgctgggggaataatatggaaaaagaacaaagcgaagatcgcccaagcatccctgagtttgagaagaccgacgccaacaaactctatgatgctctggagacgatttcactgctggagaagaagttggacgaatccgaaaagcgcgggagcgagctggccgcgagctattgtgacggcgtagtcggcgatgaatacggccatccttattgtcgttataaagtggaacgcgacgccgccttggccgaagtcgagcgcctgcgagaatcaaaaggcgatccctctggcagcttcgacagatgtatgaaggtgatgtacgagcgcgacgagaatgcaaaacaactcgacgccgccttggccagggtcgcggagctggaagggaagttgacggactgggtgcacgaagggttccggctcaacgaggcgctagcggtcgccaaggctcaacccagcgtgccggaaatatctggcatcggtcgcgatgccgaacatcccagagctgtagtgctgtatctgcgtaacgaacccagcgatgaagatatgcgagcaattcagaactttttgcgcgccatggccgcccccgctcagcacagcgtgccgaaagcatggctcgacgttcaggcagagcgccgccggcaggtcgaggcccaggcgctaaggcaggaagtcgcagcactgcgcgcaagggcggatgttttgccggaggtgttcgggcttgagcggtaccgcgtagaaaaaactgggaagggtttctggccatactgcgtgcgtgcgggggatggaacgcgtgaactgttcgtcggccacttgaagcagtgtcagcgggtagcgaccgaattggctacggcgtttgaagatgggaagtttatcgccgcgcccggcagctcggctcagcacagcgtgccggaggggtggaagctcgtaccgatggacccgacatcgcagatgacctatgtcggtcagtccctgcgttatgacgcggtaaacagcatcggcgagatttaccggcaaatgctcgccgtagctccctcacccatcgatccggccgcgcatcctcagccgtgccagcaaccacaggcccatcctgcccgctgcgggtgcgagcggtaagtgccaagtaaggaattcatgtaatggaaccgaagaaaccttcaccagtagatggagtcatcatgaccagcctcgacgttctcaggaaggcaaagcctgaagctcaggacgagtatgccctgtccatgttcgcaacggcgatccgccagaagttacagcgctcccgcgataagggccgaggtggctggatcgactgcgacgaaaatgtcctgctggatggattcgccgagcatgcgctgaagggcaatgagaacaacctcctggacctggcgacgttcctgatgttcatgtgggtgcgcggcatcgatgatgcgaagattcccccggcgctcgaaaaggcgcgacagcacaagatcatggaagcctggagtcgaatccatgaagatggcctaaactccgccagaaaggcgagtgcggcgcgacagttcgtggaagttcctcgacgcaaggggcgcccggagcgacttgcatgaagcctcacgaaataagactggcccaggccgaagagttcctgcgcgaactcggccgagggattccggacgacgaacgggtgatggtcggctacgctgaagaggccacggtccaaaccgacgagaacggccgcaagctcaacgccggctggtggcctgtgccctggaaggaaggcaagtacatcaattccaggtccaacgcctatgcctgtatctcgtcatccatcaagacgcccaacccgaagaccggccagatgcgatactggcgcggcgaggcctctttcggccacggcctggcgttaatggtagatgacatcggctccggcaaagggtccaagggtgacttcgaccgcgacgagttccgcgagcgactggagccgaccgcgattgtggagacttcgccgaacaactaccagttctggtatttcttcaaagagccgatgtcccacatgctccagttcaaggcgctgctctattcgttcgtggaccaggtgctaaagaaaggcggcgacaacacagtcaaggacgtcagccgttacggccggatgcccttcggcttcaacaacaagcgcgggaaagacggcaagttcaaatatgccgacgaaaacggcaagcccgaactcgtgcgcctgtacagcgccgactattccaagcgctactcgccggaagagatcgcccaggcattcggcgtccgcatcatcatgccacagatgaagaaggtggagataaaccgcgacgattgggtgtatgaccaagtatggctgaagtatgccgagcacatctgcacgaaatacaagatgggcgaagcggcaggcggccaggtccagcagaatatgtccggcaaataccgcatccgctgtccatggggcgacgagcacaccaacggcgatcctttcggagcatactttcgcggaccgatacctggcgccgagcacgaatatgtgttcggttgcgggcacgatacttgccgcaaagagcatcgccggacttgggcggccttcacggatgaagtcgtgctaccctatatcgtcgaacaattagaaagaatcaaccgccgtcatatcggtgaggagtagacaatatgcaaaacgatcctggaatcctgattaccgccatcggcttgctgttcctcggccttatcatcttcttcgaaggcctaaaggggtggaaaatacaagtcgcaaacttcctcgcgtcgcttctgtgcttcttcttcggcctttctgctttgacgttctggttcgtcgttgcgtttgatgtattttaatcgacgaacggtacagaaattttcggatggggacggaacttattagctatgccggtttaggtaggagataatagccgtccctttcgcctcaatgtgtagaggcaatgttgaatccgatcatgtaaagcagaaggcggcaaacctaacatgattatcgacgacgataacattcttgatgatgacgaatcggggtccagtgagttcgatctcacacagatagaagatgctggaatggaccctttgatgaccgccgcaagtaaagcggccgacgatgcgattgcgaggaatgagacttaccgagcgcaaaaggcagcaaagtatgcagaggcgtatgcggaaccagatttgaagaagcgagcgcgattgttgatgctcgatcaggcctttgatcttccggtcagccggctggtgaaaggaccgttcgacgacttcatcaccaagtacagctcgacttcagacagcaactacctcgcggtctatgatacgttgttctgtaagggcgacggaactgtcccacacccgcacttcgacgagtttcgcggccggctggtggaccaccgaggcgtggcgttcaacaacaaaaccctcgatccgattgacctgatgggcgccctcgcggctgcggccttggacgatccctcgattaagaagacgattgagacttgctgcgtgtgggcgcgtcgatatcgccgcaactctttgatcgaaacgtttgagaagaagataccggattgggacggcgaagagcggatcgaaacgctgctgatcgacttgttcaaaccgttcgacaccgagcttaaccggatggtgagcaagtatttctggctgagcttgtactgccgcatcaactaccctggaatctcggcgccgatctcgttggcgttgattggtgggcaggatgctgggaagacttacttttcaatcttgatctgtaaagagttgtcgagcgaccgaaagttatcgccggtccagcttgacctgagccgtcatgaccagacgccatttttgcgcaatatcactggcaactcggtgatcgcgaacgtcggcgaaatgtccggcttcaaaaagggcgacatggaacgcattaaagagttcctggtgcgatccgatgatactttcgatcagaagtttgaaccaggcgaaactatcagtcgacaatggatcaccatcatggacggcaacggctatgatggtcttcaacgggatgagtcaggaaaccgtcgattttatccaatgttcgtggcgcaacttcccgacgaggatggcaagccgaattgggttaaaccgggcgatggaaatgaaactttccgcgttgacttcaccgacttcggccgcaaattctggcaagccatggctgagtgccgcgcctggattaaggcgaatggcgtggagggatatctcagtctagttcgggcgaccaacaacgaagtccagaaattctctatttcggaaatggagaatgcgcgtggcgtggttcgtgatgacacgattgatatgtatctgatcaacgtgctgatcagttgcgagttcgaagagatcaagcctggcaggaattcaaagaatcctggatggagagtcaacaccatcgaaatcctgaaatggttcgatattctcgccaggaagaagccgatttctcgccacttaactccgcacctgaaggcgctaggatttgttccgaataagaatggcttgaatggctggtgcctgcctgtagataaggttgcgcctggatggaccagagatatgcacacgacgttgccgccgttcaatgatgtgcttgtatacttgctgaggaaggttgattctgaggtgactgatgaagaggcaatgattcaaatccgcaaagttaaggccgagcgcgcaaggatattgggtgaggatttctgatgtagtgatggagtatacttggactaggccgccttcgggcggtcttttctttggtgcggagtacattcgatttcggttgtggccgagtgagattcggaagctatctggtaattagggtttggtggcgatggcgcgttgtggaaagttcgtgaacgttggatcaaggattttgtgcggtgattggatgaattgtggaaaatcgacgattctgactggatttttggggtcggccgcgccggtcttactggtaattaccgaaaccgggaatttgggtcgagccttagtgccgcgtgggcttgaagcgcttattcggatacttcccggtttcggatgcagccgcaaaagtatactacagcgaaaatcgattgcac

SEQ ID NO: 20 - DNA, 65822 bp, Myoviridae Pbunavirus
  misc_feature (1)..(65822)
aatcctaatagaaaaaatctatcacggacgttacctatctttaaaattaataaaattaatagtaatttggtaatttggtatactttggtatttgaaagcctcgcggcactaagcttgtacatatcccgtgaagtttccgattccagccagctcgcggcagggtcgccggaaacttccggacttccaatccatgggtcgcggcaacaccacggcggactaagcggcaagtgccaaaactcgacgaacggaaccggaaatttgggagcgcgacagaatcgctcagctggacatatttctaacattcgatttaacactcaatccaaacactcaccccatcgtcgcccgccaaccgccgactcgatcctcatccaccagcggatcgcccgtataacatcctataacaccacctaacactcattcaccatcaaacccacccagacctacagcccacccacaagcagcccatagacgcgatccctggccccatagtacaatcgcgccatactcagtgtcgcgacagagcaccaggccccatccaccaaccgagccaccgcgacgactccagaatcgaactcagggacgcagcaccaaatgaccaaattctacagccccgacgatctagtcacgccacaggaattcgcagacccgcatttcgcggcgatcaaccaaaagcgattcgacctgtacatcgacctgcgcgtccaaggttacagctcctggcgggtcttccgggccatctggggcgaggagcatatggacggtcccgcgcaggcccgcatcttcgcgatggagtccaacccgtactatcgcaagcagttcaaggccaagttgaacgcgaccaaaacgtccgatttgtggaatccaaagacggcgctccacgaactcctccaaatggttcgtgaccccaccgtcaaggactccagccgtctgtcggccatcaaggaattgaacgttctggctgaaatcacgttcgtggacgagtcgggcaagaccaggatcggtcgcggcctggccgacttctacgcatcagaagccgaggctcagaccgccaccgtcgctgctgcggccgaagccaatggctatgtgccggaaggcgaagagggagatttcccgtctccgacgccggaaccgaccgaggaagaccgcgccaaccccatttagacatgaaataacatcgttctaggcccgaatcggaccgaactaaggcgacggtagcgggaagggacgaaaaacgattctagggcggttctaggaagcagtagcctaaccctcagaaacgacaaagccccggactctagttcagaatccggggctttctttgggcgccttattcgccagcttcgatgatttcgaagttgtatttgacgccttcgtgctcgaaagtcattttgccagccgccttcagctgcatgcggaatcggatgtgcttcgaagaaggcaggccgaactcgatgaatgctgcgttggtggaccggaactcgccgcgcttgcctttgacagtcacagccacgccatggcgctgagtgcgtttcttggaaacttccgggtctttccaggagttggcgatggctgccgacaggtctttggtctctttggccttctccggcgcgttcttggcctcttcgcgcatcttccggatttcttccagcgcttcctcttcggtgatctcttcttcaggcttcagattctcttcctcggccttctcttcttccttcttcttggaagtgcgggttttgtagactttggccggggcttcctcttcctgaaaggcttcttcctcggccggcagagcattcaggatggcgaggcagcgacgctcagcagtcttgcggtcggagaagcgcttgacagtcgcatcggcgttgtgagcgttgtagaaggcgaccagttctttcatttctgcgttctggatgtcgccgaaggttttgatggagttggtcatcttgcgatcctctgttttggaagatttcgttcgggcttcggtttgtcgccccgttgaaagagattatgcctaggtcgattctgcgtgtctacatttatttcatcagattgatcgcaaagccgacgaacggttgtctgatgtgaaaacaccgcagagcaggctgcggtgtttgttggcgagggcgatggtcaagcgaacggatcgcccagcatatcttcagacggggcacgttgcatatcgcccagcttgtcttcgtcagttgccgggctggacgggatcgcgccggaccgaagcgacagagattccgactgcctgctcacctgcggagccggaggagcttttggcgcagtaggggcaggcgggaccggcaggcctggaggagccatcggcgccatgggcggttctggaagatcaggaagactcggcgctatgccgccaaaggaccgctgcgactgctgcgccggattgtcgccgaacatttcggcggatcggttgtccttgatgacttgacctatggccgtcttgtcgccgcccggctctgccggatcgaagcccgtgaatggagtggtaacgcagcgcatgttcggatgggtaggcagatttttcaggactatggagtctgcccagacatacggattcttgtggttgccgggtccgtggctgatgatctcggcaggaatgtggccgttcatggtgagccattccgccatcccctgccgggtcagcgggcttactacgatctggccagtggactcttcggcgacggcgaacagatcaccgagcttgaatccgatgatcatatagttggacctggactcgccgacgaaagccagggtttcgatgttgtggtggatatcttgatcttcccagatgtacagcatggtgtcactcctctttggcgaaattgttctttcgaaggtagtaggcgatcttcagtcgtggccagaacggcgtcagtgccacgttgtcgtgacggatgatcgcaaagtggtccgttccttccaaccctgcgatgaagcagcgttcccaggcgctcccgctgtagcgatcatctggcttccagacgttcatgcctgagcttagttcgctcgactcccatttatgatcgatcttgacgttcctcatggctccctcaataaggctgcttgttgtgctcgaccagagacataccggccggaactttgaagcggacgtattcgatcatcatcgccgttcgacgccgattcgtgccagactcgtcattaacgaagagttcgcactgatgcgggatgactcgcgtcaccaggtcttcgcctttcgaaccgtagaactttatgtaggctgcgacgcctcgcgtcatgttcagatggaccgtttcgcagagtcgctgtgcggccgacgcgctggacagatcggtcggactgaccgtcacccagtaatggccactttgttctttatcggacatcaactgccctccaatgagaaagcctctgccgagtcgcagaggctggttgttgttagtcgcgcttcaacagaacgactttgtcgtatgcgcgatatttaccgcgccagtcttcccagtagtcgccggccgggcaggtaagctccagggtgatttcgtcgcgccagcattcgacggaaaggacaattgccttgttcctggttgcggaatccgctctgagcttaatcaggatttcgtcgcccgttttcagctcatcaactctcacaactttggccatgacacaatcctgtttgaagaggcgcggccggaaccaacccagccgcgccgatggattaacgtttgtgaaggatggacacggtgtccacgtcgaggatgctgatggtacggcgacggcgcggattgctgcgttcatggatgcgaatcaggttcgcaactggagcttcgtccaccacccatacatcttcctgcttctgcgtccggagcaggaccgttacttctgtgttctgggcgaggccgttgcagatgaaagtgaacttggacgagggagttctgtacatttcgagattcctttttggacttcggggtccgacttctcagccggtgaagagattatgcctgatcatcaccatcgagtaaagcacttgtgtaccaattctccagttaaatggaaccaaagcgcggtatcgctgatcgctacgcttccacgccatggtccttcttgcttacagacttcgaaccacaagctgatttccattctggccaggactcggccgaaggattcgagccggcgccggctagccaggatgtcgacattcacccgccgattgatttcgtatcggcgaccgttgatgacgaagaccaggcgcagggtgcgtccgtccagacattcccagtatctggtttcataccgaagccagtagcgcttaccagccgggcctaccatggtcatttaatcgatgctcctggacgcgccacgcggtccgttcggcgggacgggatcgaaccgccccaggatatagtcgggccggcgcgcttcctgaggacacacggcgagaaggcgccatcctgcgtccagggcgtactggagttcgtccgtgcagcagtcttccttgagcagcagacggttgatgctctggagattcggaccagggatagcagagcctgtgaccgagttccagccttcgataccgtgcaccatctgcggctggttgatgtagccttcggacctgccagccaaccggctcgcggccagctccaggcgctccagcatgggtcgcagagcggcttccgggtcaacatcgtcccagagcaggaccaggttgatgatggtgtacggatagtccttgtccaggtcccaggccgaagcggtcagacggcccaggccgatttcattacacatcacaggaacgtcgttgctccaggtggacggctcccagttccgctcgccaggattcccgattgttacgccttccaggttccccaggagaatgtggagcttgctgacatattccgcctccagcgctttccgctcttcgtcggtctggttgtggcgatagaaggatggagggctgacttttgcatggtagagtttcatggcggttcctcggttttggaagatttgaaagttagagaatggtgtcgcagtatttctcgaaaggactctggcgcttcttctcgcagatcgcgcaggtgatttccaggtcgggcagctcgctgtaagtcttgccgagatacagccagcgcttgcacagactgcggccgtccgacgtgaagaagtggactttgcgagcattgccgggttgcgcccagccaccttgatcgtttttgcgcttgctcatggcgatatttcctttggatctggaatccatgccgtccgttcgctcacccaaactccgtctacatagatcaggactgacagagcagtcgcgccaaacccgaagcctacatagaatgaaccgggatcgatttccatggtggcgctattggtggcgctattgaaatcgacttcaaagttgaacatcgaatggccactcataccatcaccatgtcgatttcattgatgaagaaatgaacatcgacaccatcggcgcgaccggtgtaacgcagccgagtcgtcccatcaatgtgggcttcctcgacgccgatgacttccaggatggtgtcgttgcagtaaagcttgacgaacatcttgatgccggagccaatcgccgcgaaggcgatctgcttgtacaggtcttgcttgatcacgctttgcgctcctgtttgcggatgtattctgccctggcttcggcttcgaacttcgcccaaagcgcgttgtcgactggaccccagggaccggtctgagtcccgtccaccggcgcgaacttgccaccggcgcgacgatacttggacagagttctcaggctgatgattttctcttcttgggaatcgagttggacgatcacttgacatacttcccgaagtagcaggtgtggagtatttccatacccttggagatagccttcagcttgataccgaaattcttgatcgcccagtccagatcgtggtgatagaactcgatgatgttgacgatttggccggcgctgtagtggatgacgcgaaccttgccgttccagcggaaatcttcgcggctgtttacggcctcgacttcgatggtgtcgtttctgccgatggtccatttggagctagtcatgtcgcaatcctctttttggagtgtttcgcgtttcgatgaggtaactatacctcagtcacctcatcgagtaaagcacttttgaacagattatctgaaatttctggaagacagatccatcggctgattcagtcaatcaatcggcggaaccgagacgccacccgttgcgggcgaaggccgagcgaccagacagcttgcgacactggatggagctaccatcgtcgaaggtgtaagatacggcccagtccaggcgctcgcgacgtactgccgcggcagcgatatcttccagacgggctttgagaagttgttctgctttggtcatttcaagttcctctttggagcgcttctggcatcgatgagatgactatacctaagtcatctcatcgagtaaagcacttctgaggaattatctgaaatttctggaggccaggaattgtcgccagagccagtcaacgtgatcgttgagatagcgctcgccatcggacgacagagccaggcagccgtcctttatgccgagcttggagccggcaatccattcgaactcgaactggagcgttcctgggcgaggggtatgggacatgatgtacttttgcacgatcaggaatcctcgaaaggtttggcgttcgcgatggccgcgattttctgcatgccgatgcgatagaattcggcctcttccctggccttggccagctgctccctggcttcgcacgccagcttgtgctgattgttggcgttctggatgcttccgtccagactcctgtccagttcttcccgaagagccttctgcgacgccagctctgcctccaaatcctggattctgagctggagctggcgattcgtctcggcaagcttgttttcgtgagcaatggagttctgaaggcattcatccagatgagctttttcgagcttcagctggttttcgcgatccgcgtacgcagtaagacatttggtcagacgagcctgttctttcacaagatcgactttgcggagcttggccctggccagagctttgcgaagtgactccagctcaagcgggtgaagatcagcatccgggtcttcacgctcttccttcggctccatccgcaggtagtattggccggcagcgaaggccaatagggcacggtcggaattctctacggaagcggccatgaagtgggaattataacgaggcagaaacttgcccgcctctgggtcccagcacaggctatccgccataggccagaatttccggaagttatctgcgttcacgcccaccttgaccgtttccggcgcacctgaatccgtcgccacttccaggttcaggtgaatggtgccggtgatgtactggaagtacactatgctagacataacacaaactccatgagaagtcgcggccgggaccatcctggccgcgcatcgtgattactcttcgccttcgtccgcgctcagccactcttcgaaggcgaaattcactttcgactcgacccaatcctgcagctcatcggcgaactcgtcactgtcgatatccatcggaacgcccagagtttcttcattccacaattcagcattcagctcgaactggaccatttgctcgccatcgacttccatcaggatgcggtctgcgacttcatagtcgtctacatcgaacagatggccgccagtcaggaggtgctggacgaaagcttcatcgagattggtgacttcgatctggacttgtttggtcattttccgtctccttacttagcggctttgaattgggctttgaggttggccagttcagctttcagatcgatcatcgcctgaccgcgcaggccttccatttcggcctcgctgattgcgatcttggctgcgcggattttgtcgttgatttgatctttagtcatttcggcttccttttgtttgaagggtttcgcgtttcgatgaggagattatgccgacagtcagactggaagtaaagtgtctgatcgaagaaatttctgtacaccgacgaacggttgcgctcgaccgtctgctgcggtgtcgatatactcggcctattgcgaacaatggactgattaaatgttcaagctcaatcctgcactgcgagcggtctggcgaactcgtgcccgttacaaagtcatctatggcggccgggcgtcttcgaagtcgcacgacgctggcggtatagccgttttcctcgcggccaactacaagctcaaattcctctgtgctcgccagttccagaaccgcatcagcgaatctgtctacacattgatcaaagacaagatcgaaaactcagagtataatggcgaattcatcttcaccaagaactccatcaagcacaagattaccggctcagagttcctgttttatgggatcgcccgtaacctgtcggaaatcaagtccaccgaaggcatcgacattctctggcttgaggaagctcactacctgacacaggagcagtgggaagttatcgagccgaccatccggaaagagaactctgaaatctggatcatcttcaaccctaacgaagtcaccgatttcgtatatcagaacttcgtggtcaaaccaccgaaagactcctgcgtcaagatgatcaactggaacgaaaatccgttcctaagcgagacgatgctcaaagtgattcacgaagcctatgaacgcgaccgggagcaggccgagcacatttatggcgggattccgaagactggaggcgacaaatccgtcatcaacctcaagttcattctcgcggccatcgacgcccacaagaaactcggctgggagccggccggatcgaagcgcatcggcttcgacgttgcggacgacggcgaggatgcgaacgccactacgctcatgcacggcaacgtcatcatggaagtggacgaatgggacggcctggaagatgaactgctcaaatcgtccagtcgcgtttacaacctggcgaagatgaaaggcgcatcggtcacttatgactccatcggcgtcggcgctcatgtcggttcgaagttcgccgagttgaacgatgccagcccagacttcaaactgatctatgacccattcaacgcgggcggcgctgtcgataagcctgatgacgtctatatgaagctgccgcacacgacgatcaagaacaaagaccacttcagcaacatcaaggcgcagaagtgggaagaagtcgcgacccgattcaggaagacttatgaagcggttgagcatggaaaggtttatccatttgacgaattgatttcgatcaactctgaaacgattcacccggacaaactaaatcaactgtgtatcgaactttcgtcaccgcgcaaagacctggacatgaacggccggttcaaagtcgagtccaagaaggatatgcgcgagaaacgcaagatcaagtcaccgaacatcgctgactcggtgattatgtcggccattctgccgatccggaagcccaaaggcttcttcgacttctaaacatagaaaagcccggatcgctccgggcttcgggtcttactcggtgcggttcctggcgctgagtgtcgacgcaacggcctcgccgactcccagggcttcctggccggccgcgagcgcttcggcttccgactcgacgatgaaatcatcaccttggccatcgcctggtggaacctcgaccagcacggcttcttcgccttcgaaccgcaggtcataggtcttttcgacggacagaccgtaacgagcgttgagcgcgtcccagagctgggcctcataggtccgcaggtcttgcagagctttctggtggctgagcatggccatgtcaacggcccgttgcagggtttcgtccaggacgttgaaccgaatgcgaagagaacgaatccgctcgacgacttccgcatccactacatgtctttcgatcattacttttcacctttgctgaatgtaacgttgtagccgttgtcggccaggtaggtcagggcgccttcgaaggaagttccgacgaggtgcttgagcttcatttcgcgttgcgcggccaaccagaatgcagttccggaaaactctgcgcggccttcggacaaaaccctgccatcaggcccggcgatccgtacatggacggaagatagcttgatcggcatcagtgaatacctccactggcttgcgacggcatgctttcggcgcgagcggcttcgcagtccgggcagggacaggcttggcggacgcgctccaactcgtcggcatccatgacatagagcttcccgtcggcagtgtcatgtgccatagcgatgttcgggaagtcggttgcgctcaggccggcgacagtgcggatttcgtcccagagcaccagatgctcggcattcagtcgggcggcgagcgcttcgtgctctttagcgacgcgcgccatgaactcgtccatacggaatgcgaattccgtatcgatggcacgggccgaggccatggagctgaggcgaatcggttctttcttcatgatgattctcttttggttggtggtggctaatgtccgtgcctattcaaggccggctcaatgcggcgaagaacaacacgatgaagaggagcgaaaagaatgcgaacgccagagatattccggaaatcagctttgctatgccctgcatctcagtcgccttggcagcgagtctggccttagcctcgataacttccggtcgtggcgactgaacatattctaaggcctcttcccgcgctttttcggcctcgaccaacctagggtcgcgggccgagacttcgctgtgccctggcctcgcgggatgggcttgcagcgatggagggagttcagccgccacgactccatagtctgcgcaggcccaagcgatcccgatgaggatcgcgaggatggattggacgattcgcagcatcactttgtcgctagggaagttcatgatcaatcctccaccgaccgaacgatttccatgttacgcccggcattggtccctgcattgaaggcgcgccgaccgtcgctatcgtccagacgcatgagcttggtgacattcgacttcttgtagccaggatcgccgaaatgttcgtgaaccgcagcttccttcaccacaaccagagacgttccggcagaagataccagctccatgcgcttcctggtgatggattgaaggcgatagctgatttcctgggtcgcggccagcttgaattgcgcggcaacctttacgttgaaacgttcgtacccttgagccttctgatactcccggcacagacgatcaatggcctcgaccagggagttgaacatgttcaccgccagctcaacgtccgacttgtagcctttaaagcgtacggcatgaccccagcgcttggtagtgcttccgtcgcgggcgctcctggatgccttagccgatgctctgtggttgttgatgccaccggcgaaatccatgatgcagtcattgtacgtcgccacggccactgagaaaaacttcatccagttcgggattgcggaatagtaacgagtcgcaatctgctcgtcgaactcttcacgaatctcgccggtcgcttcgaagccgtggaggtcatacttgtccttcagcttcttcacgcgctcggctgcgatggccgcttcgtgcgggctggaggagtcggctgccatggcggtcagtttgcggatgcggtctttcgccttctcgatggcttccggggtgaattcgttctggtcggtcatggtcggttccttttgtctgaagggtttcgcatttcaatggagctattctgccttcattcagaatggaagtaaagcactttcttccactatttcgtcatcgactggaagaaattccagatccaatcacctgctaccagcaagaggatgagggcggcaaagaacaagacagcggccgcgagctgtgcgcccggcttcagtttgggatggctgagcttgggctctacgggaacggccggagcgctagcgctgcaaccggcgtctcctgggccgtagccgatgccgcgttcacacgcctggagcgacaccagggatttaagatactcggtctgcttttgcgactcttcgtagatgccggcgacggcgaaccagagggcgaacactacggacgtacacacaacccaggcgccggtcagcaggagggccagcgggccgatgacgaagacggtagcagccaggacgattgcgccgccccagatgatgaagccggccagaccattagtgatgtcgacacagaactttttcattttcagattccttcggttacgggatggaggggatttgaaactctgcgccgccgagaacatcaatgacgacttcccagagcgtcggaacagaccactggtaacggtcgaagtcggtttcaggatcgacgcccagcgtcacataggaagtggcaggccatttatgaacactgcctttccgcatgagagtcgccacgcggccgtcaccgagcggattcgtcctgtgcggaacgtacgcagacatcgaatattgctgcccggcgtcgacaacaaatctttgcctctggcgcagacatacagagcccacaggattccagccgcgaccgccgcaagcctggcgagccgaagaatgctcataaccttcgtgagtcatttcgccgaggcaagccgagcgatcctcgtaatagttgatgttctccatcgatccaaccagcaccagagactcgaaatcgaatcgatgatcgtggatggccgagtgattgaagcaaagccgacgcggcagctccgggtgccaaacatggaggcgaccggccggaagttggacctgaatgaaccccaggccgtgcagagtgatcttgtccttcatcgggtcatggacggtgctcatggataatcctcagtagcagaaatgcattgtgagagttacgattgacaagccggtcgcccatagaagggcgaaccaggccatggctttgatggtcgtgtagatcatccgaagaattttccggcacagatcgggccaatgcccatttcgatggatgcgtggttggtcaactcgcgaccgcagcaggagcactgaccagtcttccgaccgtaggcgactgccgattccatcggcttttcgaacatcttcagaacgtcgtcgtgctcagtgtcggtgcagtcgcggctcttgatgaatttgccattggtgatccggccgaggtagatgtctcccaggacatacagactcccggcgttccgactgttagcgctagcctctttcacaacaacgatgagcggctcctcgccttcgccagccaggcggattttcgggcgcttgattccagactctttcgccttctcaaatgctttctcgataccagaaatgtccagagtcggcgcagcagcttcctgcgcggccactttctcgcgatacttggcgaagttttcgatggcgcgcttcgcagcagcgatctgattttctgtcaaggagccgtatttatacaacgactcctgaaggctctgagcgaagctgaaggaatttccagtccaccactcgacgatgtccgggtgcgcggcttcgaaggccttaattttgaggtcgcgctcttgcgcagcgctacagattttctcgatgcgcttttctgccgccttagcacggctcttggcgcgctgctccgggctggttttgtactctttgtatccgacgccgccgcaggcaaagcaggcgcgaccataagacgaagggccacggtacaggccggtgcctgcgcatttggtgcacttgtcgcgatacagcttcacttccttccgggagttcgggcgggcacccattgacacgtcttccagggtcttcggcgcttcgttgttgatctctacggtagcgaagtcatcacccaggtcttcgaagccggtgaacagattctctgctgcgttcatatcgattctcctgtttggaaagttcgtttcgatgggttgactatacgccagaaatggcaaaacggtagcactttcgcactaccgttcgtcgggtcgcagacgatcaataaatatcgctattgatcttgaatccatgctcagcgccgtcgttgtagtcatactcagcatagccgtcgcagtagtcgttcaaatgctgaatgatgccaagaacgtcgttcgcggctttgtgtcgtttcgcggcgatggtcttggcgatgctgtcgccgacttccagggtttcggccgtccggcgatggatcagcaggcgactccaaagatagagccggacgcgacgaataatgtcgcgatggcgctccagtcgtccgtgcaacttttcaatttcgtgctcgcgagattttaatactcgtcgaagccgttgaacttccaactccaaatcggccttagtagccatgttcacctcagaaaggaaaatcgtctgagactccaggaagctcgacgattattgttgagcctgatcggtctagaatgcatccgaccgagccagccctgtgtggatagggtctacacgaactataacaggtgacttccatgactattcgccaggtcgatcctccacaccatctgcaaattggcgggcgctctagaatgcatccgaccgagccagccctgtgtggatagggtctacacgaactataacaggtgacttccatgactattcgccaggtcgatcctccacaccatctgcaaattggcgggcgcttcgacttcagttttcgttcgtccaggacggcgcgtctgtcgcaggaaaggcagcgtgccttaaccgacgtaaccatgggtatagtcgatcattcggatgagctcatcatcctctgattctctcgacttcagaccgcccaaagagtccgactggccgtcgcatttcgcatcgatatccatcgaagacaggaatcctgccgatactgcggtgatatcaactttgtcgccggccttcttgaagccttcgcactcagcatcgagggccacaattgcactcgctgccatgttcacgtgactgatgaggtcggggaagatcacaggaacttcacgcgacatgccacggaccgtcagcttcaggactacatacttcatactcactatcccttttgtatgtgaggaaagaacttgctgttttccggatgatggaagcgctcggccgcaggcggtctttcttccggacattgaatcgtcgaaggagggaaaaccgcgccggcgataatcgccgcgaggagtgcagcggatgtcgacatccagagggcggtttccaggctcacccgaacttccggacggcgcggcttcattcgctccaccctcttcccggttcataggatggtagatcgccgccgcgaacccagttgtcccacatatggttcagaccagtcggtggctggggcggcggactgtagaatccgggagtctcagtgctgctcaggaaataaggcgtgcaaacggcctggacgaccaattggtgccgctcccacatcttatcaatcgctcttagcatgacgtcttcgcactgagccttactgtcgaaccgtctgctagtatggtccggcatctggacgcagccgtctccagtgcaaaggaaagcagtagcaatccatacggtgatactcgccatttcgtcaccctctttagttgatgagcagagtctattccatctgctcgccaggagtaaagcgcttttcgtcgggataaatgccgatgatgtctgcgtcgagcatccaaatctccacggacggatcgtcgctgctgatttggtacaggttgtacagctcccgtccgccgacagcgcgctcgcctcgcggctcaaccgccagaaccttgccgtgcccttctccgtgctcgtccatgtatatgacgtgatcgccgacttcatagctttctttcgtgacgaggcgtgaacgcgagctgttctgcgattccaccatccaggaatccagcacgccgcctttcatgtcgcgaaacaatcttgccgatttgtcgcaatcgaatacgcccagaacttcgccgtctttcaacacgatatgtacgattggcaaaagagtattcatgtttaatctccattggttgataattagagtctaatctgccgaaaagttcccgtaaagaattattttctcataactgattagttgcaactgttaatctgatgtatatgtttgaatctcttttgaacgtttgatgtttcccctataataagcgcacacagccaacaaccacgtggaactacaatgtttaaactttcctggatattcgggcgcaaaaaggataatgctgcctgttctgaatcggcgccggagaaagtcgcacaaatccctcaacacgatccgctcgaccccatgatcaagctgggaaggattcgcggctggaacgtcgagccggagaaagccccggtcattcgtagtgtgaaagatttcctggagccgggcctatctgtcgcaatggatagtgcgtatggtgatggaccaaccccggccgcgaaggctgctgcgggcggccagaatccctatgtcgtcccgactatgttgcaggactggtacaattcccaagggttcatcggataccaagcttgcgcaatcatttcccaacactggttggtggacaaagcttgttccatgtctggggaagacgcagcacggaacggatgggaactcaaatcggacggcaggaagctatccgatgaacaaagtgcgctgatcgcccggcgcgacatggagtttcgcgtcaaagacaacctcgtcgaactcaacagattcaagaacgttttcggcgttcgcatcgcgctgttcgttgtggagtctgacgatccggactactacgaaaaaccgttcaatccggatggaatcacgcccggctcctacaagggaatctcccagatcgatccatactgggcgatgccgcagctcactgccggctcgacggccgatccgtcttccgaacatttctatgagccggatttctggattatcagcgggaagaaatatcatcgcagccatctagtagtcgttcgcggaccgcagccgccagatatcctgaagcctacatacatcttcggcggtatcccgctcacccagagaatctatgagcgcgtgtatgcggcggaacggacggcgaacgaagccccgctgcttgccatgtcgaagcgaaccagcaccattcacgttgacgtggaaaaggccatcgcgaatgaagacgctttcaacgctcgcctggcgttctggatcgccaatcgcgataaccacggcgtgaaagtcttgggtactgatgaaagcatggagcagttcgacacgaaccttgccgacttcgacagcatcatcatgaaccaatatcagctggtcgctgccatcgccaagactccagctacgaagctcctcggcacttctccaaaaggattcaatgccactggtgagcacgaaacgatttcttatcacgaagaactggagtccattcaagagcacatattcgacccacttcttgaacgccactatttgcttctggcgaagtcggaagaaatcgatgtgcagctggaaatcgtctggaaccctgtggactccacgtccagccagcaacaagccgaattgaacaataagaaagccgcgaccgatgaaatctacatcaactctggcgttgtgtcgccggatgaagttcgcgagcgtctgcgcgacgatccgcgttccggctacaaccgactcaccgacgatcaggcagaaaccgaaccgggcatgtctccggaaaacctggccgaattcgagaaggccggtgcacagtcggccaaggcgaaaggcgaagccgagcgagccgaagcccaggcgggcgccgtagagggcgcaggcgccccggttcccgccgctccacgcgggactaagcctctcgcgaaagcggccgaggaaggggccagcgaggccgctgaaccgccgtcgcggccggaccccaaggccgagctgcggaacttgttggtcgatcttttgtcgaagctccaagacctggacgacattaaggcgccggacggcgtagacatagagcacaatgatgcgcctggcttaaagcgcacgtccaaacctggcgtgtctggcatggagccttcggtgttttcgtccaaccgcatcgtcgggcctcgtgatcattcggaactccagagaatcaaggttaatggaataaccaccttgatcgaaaatcctcgcggaagcattcggcaaggaaaggatgggagttggcgagttcagatgaaacaccactacggattcatcaagggaacgaaaggcgctgatggggatgaagtcgattgcttcgtcggtccgaatctgggatccaaacgggtcttcgtcgtcaaccaggtgaacaaggaaggtcagtttgacgagcacaagtgcatgctcggcttcaacaacatcaacgatgcgaagtctggatatctgtcctgcttccgcccaggttgggatggtctcggctccatccatgaagttgacctacccgctttccgtcgctggctggcgaacggcgacacaaccaaaccgtttggaggcgagtgatggcattcaaggcctccaaaaagcgcgaacgccgggcacctcttccggtcggaagagggaagcccataattccatcggcaggaatcgaggcctggtatcgaaagcagatgaaggatatttccaagctcatgatcgccgactatcgaagcgagattgagaaggcactgtcccagcctgcggccgaacggttcttcgccagcgacgaatccgttaacgccctgttcaagatgacccttcgaagcctacagcagcgatggaaccgcatttttgaaggcttcgcggccaagatcgccccggagtttgtcaaccggaccgaagaagcggccaccgccgcgaccctgcacagtttgtctttggccggcgtcgatcagccaagagctgcgtacaatgagagcgtcaggaataccctggaggcagcaactacttacaaccatactctcatcaccaggattcaagaggaagtccacgagaagatttacacatcagtaatgttgtctctgacttccccaaatccggaagagcaaggaacttccggcataacgaacgcacttcgcaaagtcgggaagttctctgaagatcgaatcgaactcatcgcaagagatcaaaccagcaagctttacagttcgctgagcgatgagagaatggcggaaaatggagtcgaggaattcgagtggatgcactcttctgccggcaagactcctcgccatacccacctggagaaagatgggaaaaggttcaagctgaatgaccccagactttgggagggtccgaaggccgaccaggggccgccaggatgggcgattaactgtaggtgcagaaagataccagtcatttgacatcgataggagcgctatatgccgttagttcatggcacttccaatgaggctcgttctgaaaacatcaagcgggaaatcgaagccggtaaagacccaaagcaggctgcggccatcgcttattccatccagcgcagtgagaaagggaagacggcgaaagattgttcgcctgagctcgtcgccgatcttcgcgccatggtggacgctctgtcgaggctcgtgaaatgaaccgcaagacgtgccggcgccgactcgtggtcgatgtaatcagggccaatattcacggcggattcttcagcctgaagtttgccgccatcgatttggcaatcatcggcgtcgccatcttgatgacttttggccgataatgctgagaaaatctggattctgactaaaaattctagtccggatagccgcaagttaccgtttacggaaaatagcagtaatttggaaagcctactgccgcgaggctttaacagagccagttcctaatttccgatttagccgcatgcttcaaaagtatatagcctgggaaattagaagtaacgttacaatagaattcatctataagtaacgttataatataacgtcaatctatatgctctagacgtattgaaattcaatttttaatcgggaaattggtaatttgaattagtttaggagttgaaagcctcgcggcagtaggcttggacaaatcccgtcaagtttccatggtcaaattactggattttcgcggctgaggggctggtaattagatcataatacaaattataatgtaagataacagtcgcggctacatctaattattgttccgcttatttacccttagatgtcctgcgtatataatacagccatagtccacgactcttcgaattaacgatgacaaagtcgaaaagaaaaattgacgaaaatggatatatgaccatcgagggctgcccgatcagctcttatggcgttttccagtattctgctggtcaactcggtcttccgggcgatccgacgcggattgtcaacgtatatcgcccggagtctgccgtcagcgatcctgagtacatcgaatctctgaagaatctcccgttgatcgacgagcacgaaatgctgtcgggattcgacgacgatgacgacagcgtggcccccgaagacaaaggggtggagggtatcatcacctccaacgcttactacgaagccccatgggctcgcggcgatatccgcatctattcccgcaacatgcagaatcagctggaaaggggcaaagaagacctgtccctaggctatagttgccgctacactgagcaacccggcatctggaacggaacgccttatgaagtcgtccaggacaagatgcgcggcaaccacatcgccctggtaaaagagggtcgtgtgccgggggccagagtattggatggtctgtgttttgaccatctcagttttgatttcagaccatccgatgagggtaatgaaatgagtctcaagaaagccaagcggaagccccctgtccagcgcgtagggcaagctgctgactcggcggtcgaagagttgcgcaccctgtggccgaaactctctgcgtctgtccagaagttcctgggcgaagaagagcaggagccggagcatcaggaaggcgccgctccggccgaaccgaccgacagcgagcacctgaccgagcatccgactctggaaggcgcccagaaggacgacgaagagcaggaagaggagccttccgttgtcgatccggccgtggccgccgtcgagccggagcatcaagaaagcgccgcatccgaaatgtccggtgaaggcgaagtcgccgaactgatctctcaggtcaaagccattctggctcgactggagggaacggtagccgaaggggcagacgaagagcatggcgaaggtcaagatgtcgtcgagggtttggaggagcagagcagcctcagcggctcgcaaaccgccagcgacgatggtggtgagagcaaggataacagcgaggaacttcctgaaatggcacagaagaacgcgcaagatgctgcaattcgcggtctctatcgcgacattgctgctaaagatcgcctctacaagcgtcttagctccgtggttggtgcgttcgatcaccgagctatggactcggctgaagtcgctgtttacggcgtgaaaaagctgaacatcagctgtgcgaagggccaggaagctctggcgctcgacatgtacctgaaaggcgtcgaagcctcgcgcggcgcggccagccgtcaatcgaaagcccaggattcggccggttctgctccgcagtgcgccgagctggacagctacctgaagggggagtaactcatgttccagaaacaagtttaccgccagtacactcctggttttccgggcgatctgatcgaggacggcccgaagcgggcgcggccgggtcgaatcatgtctctgtctgccgtaaatccggctgccaccgccaccggccccaaccgcatcagtcgcgctttcggttacgccggtgacgtcagcgccctcggcgaaggtcagccgaagaccatcgcggctcgcgcttctgaagtcgtgatcggcggcgccaacttctttggtgtcctcggtcatccgaagcactatgcgctgttcggttcggccggagactccctggctcccagctatgatctgcccgatggcgccgaaggcgagttcttcgacatggccaccggcctggtcgtcgaaattttcaacggcgccgcaaccgccctggacctggactatggtgacctggtcgcctatgtaccaaacaacctgcctaccgccgacaacgcgcttggcctgccggccggcgccctggttggcttcaaggctggctccatgccgaccggcttggtccagattcccaacgcacgcatcgttaacgccatcagtctgccggcccagtcggcggggaatctggttgctggcgttaccatcgtccagctcacgcagtaaggaggcgtcatgagccagatcagcaagacccattcgcgcctcgcaggccgcaatgcgaaacctttcgacctgaaaaacatcaccaatgacgccgtggcgtctctgcgccgcatcggcctggtattcgatcacgccgtcgtccaggaccagatcaaggccttggcgaaggccggcgcgttccgctccggctcggccatggacagcaacttcaccgccccggtgaccacgccgtccatcccgactcccatccagttcctgcagacctggttgccgggcttcgtgaaggtcatgaccgctgcacggaagatcgacgaaatcatcggcatcgataccgttggctcctgggaagatcaagaaatcgtccagggcatcgtggagccggccggcactgcggtggaatacggcgaccacaccaacatcccgctgaccagctggaacgccaacttcgaacgtcgcaccatcgttcgtggcgagctgggtatgatggtgggcaccctggaagagggtcgtgcctcggccatccggctgaacagcgccgaaaccaaacgccaacaggcggccatcggtctggaaatcttccgcaacgccatcggcttttatggctggcagagcggcctgggcaaccgcacctatggtttcctgaacgatcccaacctgccgccgttccagaccccgccgagccagggctggtccactgccgactgggcaggcatcatcggcgatatccgcgaggccgttcgccagctgcgtattcagagtcaagatcagatcgatccgaaggcggaaaagatcaccctggccctggccaccagcaaggtggactacctgtcggtcaccacgccatacggcatttcggtttctgactggatcgaacagacctatccgaaaatgcggatcgtgtctgctccggaactgtcaggcgtccagatgaaagcccaagagccggaagatgctctggtgctcttcgtcgaagacgtgaacgcggccgtcgatggaagcaccgatggcggcagcgtgttcagccagctggtacagagcaagttcatcaccctgggtgtcgaaaagcgggcgaagtcgtatgtggaagacttctccaacggcaccgctggtgcgctgtgtaagcgtccgtgggccgtggtgcgctacctcggcatctaaccgatgcctattcaccaaaggccgggtttccggcctttgttcactctgactctgactcggttgtaggggccggttagggcataattactaggactacgccaatgactgtttacatcgtttccgccatgactcaatccgtgtcttacaatgcgtatgacacctctgatccgtccaatcctcgccttcagcggaagattctgattcgtggccgcgccggcatcgcatcagaaacttccggcttcggcgacatgatttccgacgcggccgggcgtccgatctggaccccgcagggcgattgtactgccgtgagcgattcggatttcgagctgctccaggccaacaagattttcatgcgtcacatggataagggttatctgcgagtcgtgaagaccgacatcaccagtgaccaccagcggatttccaaagagactcgcaccatggagcgcgatggattccagcctctggacgctgctcgtctgcagcagaaaatcaaggtgactaccgccagcgcttcccaggaacaagagttccggatttaaccgagggtttcggtatggtgattttcgacgaacataagtttcgcacgctgtttccggagtttgctgatccagccgcttatccggacgtgcgcctgcagatgtatttcgacatcgcgtgcgaattcatttctgatcgcgattcgccataccggattctcaacggcaaagccctggaagcgtgcctgtatcttctgaccgcccacctcctgtcgctgtccacgatgcaagttcagggcgcggctggaggtggcgtcactgccggtgggacccagggcggtttcatcaccagcgccacggtcggcgaggtcagcgtggccaagctcgcgcccccggccaagaatggttggcagtggtggctttccgggacgccttatggtcaagagttgtgggcgctcctcagcgtcaaagcggtgggcggattctacatcggcggtcttccagagcgccgaggcttccggaaggttggagggacgttctggtgatccctggtgcgaatcttctgcgaatggccttcggggtcatcggtactcaaattgtgaaatatcgcaagtttgagcagcgagtgaagaatgatcaagctcagtacgtttccatgttcgaggagcctttcgacctggcagcgtctgttcagcgagtccgacgcgatcagtatgtccagtttaatctggagttccaacggaattacgttatgatcttcgccaactttgagatggttgacttggatcgcgatgtggccggtgaccagttcctctggaccggaagagtctttcagctggagtctcaaggctcctggttttatcaggacggctggggagtttgcctggccgtggatatcggtgcggccaagctcactgatgacgggaaaccgactttctaggtgatgtatgtttgacggcgaactgatagcgaaactggttgtcgagttgaatgcggcgatgacatctgctcaagaggctttgcagttcccggattttgaagtcgtccagaaagctcagccgacccaacagggaacgtcaaccaggccgaccatctttttccagaaactgtttgacattcctcgcggctggcctgccaccgattggcacctggacaacacggcccgcaaatatgtagaaataactcgacagcatgtagagacgactttccagatcagttcccttcattggcagaatcctgaaataactcacgtggttacggcttctgatatcgccaactatgtgagggcttatttccaagctcgatccacgattgagcgcgtaaaggaactggacttcctcattcttcgcgtgtctcaaatttccaacgaagcattcgagaacgacaatcaccagttcgaattccacccaagttttgacatggttgtaacttacaaccaatatattcgcctgtacgaaaacgcagcatattcggccgatggggtattaataggcatatgagtctgaggcgcgattcagagctaatcgccgcgcacctccagatgttaagagccatgcgcggcaggtccgtttcagccggatggtattccacggctcgatatcctgacaaggcaggcggatcggtcggaatacaagtcgcgagaatcgcacgtctcaatgagtacggcggaactatcgaccatccgggcgggaccaggtatattagggacgccattgttcggggccggtttgttggcgttcggttcgtcagaaacgactttccgggagaaaccgaggtaactaagcctcacagaattaccatcccggctagaccgtttatgcgatatgcttggaacttgttttccgcagatcgcgccgcaatccagaaccggatagccatgaggctggccagaggacagatcactccagatcaagctcttgcccagatcggcctggcgttggaaggatacatagccagaagcatcaggaccgggccatgggtggctaactcagcatctacggtcaggagaaagggattcaacagaccgctggtcgatacggcgcacatgcttcaatcgattagcagcagagtaacataaccaggagatcatccagtgatcagtcagagccgttatatccggatcatttcgggcgtaggcgcaggcgctccggtcgcaggccgaaagctgattctgcgcgtcatgactaccaacaacgtcattccgcctggaatcgtcatcgagttcgacaacgccagcgcagtcttgtcatacttcggcgcgcagtcggaagagtatcagcgggctgcggcttatttcaagttcatcagtaaaagcgtgaattcgccgtccagcatcagcttcgctcgctgggtaaacaccgccatcgcgccgatggttgttggtgacaatctgccgaagaccatcgccgatttcgccggcttctcagcaggggttctgaccatcatggtcggcgcggcagaacagaacatcaccgccatcgatacgtccgccgcgacttctatggacaacgtggcgtcgatcatccagaccgaaatccgcaagaacgccgacccgcagctggcccaggctaccgttacctggaatcagaacaccaaccagttcaccttggtcggcgccaccatcggcaccggcgtcctggccgtggcgaaatctgccgatccccaggacatgtccactgccctcggctggtccacctccaacgtcgtcaacgtcgccggccaagctgccgatcttcccgacgcggccgttgccaagagcaccaatgtcagtaacaacttcggttcgttcctgtttgccggcgcgtcgctcgacaatgaccagatcaaggccgtgtcggcctggaacgctgctcagaacaaccagttcatctacacggtcgcaacttccctggcgaacctcggcactcttttcaccttggtgaatggcaacgccgggaccgccctgaacgtgctgtcggcgactgctgccaacgacttcgtggagcagtgccccagcgagattctggccgccaccaactacgatgagccgggtgcttcgcaaaactacatgtactaccaattccctggccgcaacatcaccgtttccgacgataccgttgcgaacaccgtcgacaagagccggggcaactacatcggcgtcacccaggccaatggccagcaactcgcgttctaccagcgcggcattctgtgcggcggtccgaccgatgctgtggacatgaacgtctatgccaacgaaatctggctgaagtcggctatcgctcaagcgctcctggacttgttcctgaacgtcaatgcggttccggcgagcagcactggcgaggcgatgaccctggcggtgctgcagccggttctggacaaggcgaccgccaacggcacgttcacctacggcaaggaaatcagcgccgtccagcagcagtacatcacccaagtcaccggtgatcgccgcgcctggcgtcaagtccaaaccctgggttactggatcaacatcaccttctccagctataccaacagcaacacaggcttgaccgagtggaaggccaattacacgctgatctattcgaagggcgatgccatccgcttcgtcgaaggatcggatgtgatgatctaatggtttgcggcggactcgatccgccgcgaccttccataaatggagtgaggaataaacaatgatcaacatttctgcgttcggctcgatctgccagttcacggcaagcagaactttcccgaacggattcaccgtcaccgagtttgccgacgatgcggaccccatcgacagcccgccgttcactgcggccgataccggcgtcggcctcaacggtgacatggtagtctggaaccgggcgaacatcctggaagtcgtcgtcaacgtcatcccgaacaccgagggcgagcgcaacctggcagtcctgctggatgccaaccgcaccgggaaagacaagtcgggcgctcgtgatgtcgtcggtttggtcgtggcgatgccggacggcagcaaaatcacctgcaccaacggcacccccatcgacggcgttctgatcaacgcggtggcaagcgtcggccgtctgaagaccaagccgtatcggttccgattcgaaaaagtgatcaaagccggtactagctgatgaagaaaattccgctgacagcagtccccaaccaggcgatctcattcaacgccggtagcagctattggaagattcgcctgtaccagaacatggacatgatgaatgccgatatcagccgcgacggcgtgatcgtttgccatggggtccgctgcttcggcgggattcctcttctccaatacagccatcagtaccgacctgactatggaaatttcgtcttcgaccgcgacgccgattggacattgttcggcgacggcatcaacctgttctatctggacggcgccgaattcgccgagtatcaggcgcttgccacgaggaaagaatgagcacatcaacgatcagaaccgggacgaacaacgatatccttttggacgacaatggaaacatggttatcctcagggatgtcgaagcgtgcgcccaggacgttcgggcggcgatgctcatgcgcaccggcgaaaacattttcgatgtgaactccggtgtgggatatttcgaatacatcttctcgccgcagaaaagctatgatgacgctcgcaaatccatcgcggatgcaattttatcctcaccggatgtgaccggcatcgagcagcttgacatcgacataaccggggaagtcttcggcgtcgatgcgaaagttatcaccatccacgggcctgttaccacaggagtttgaaatgagtaccatccgcatccaatacgccaacggcacccaactgttcctggacggcaaaaatccgccgcccctggacccgctgccctcgtttaacccgtctgtcgaagatctggaaggcctggaccgcgaaaagaacaccgacaagggcgactcctcgccggccggtcttcccgttcccccggtaaacgtcgattccaatgtcgacaacggcggaaccatcccggctccggtatcgaccgacgctcctgcggccgaatcggccccggaaggcgcccaggaagctcctgcagcgggccaaggcgacgagaaaggcgccgaggaagccccgactaccgccccagtagaaaaggccgaggaaacggcctcgccggccgctgaagaggaagccccggctcccgccaaggccacctctcgcaaaaccaccagcaagtaaggactcgacatgatcaacgtcagcggcttcggcacaggaattgtaatagtttccgcctcatcgttcccgatggggttttccttgtcgaagttcgctgatgatgagagtccgatatcctccaaagagctggagccgttcggatatgagatgctttatgacggcggcctattcgcctttgacaaggctgctcctctggaagtatctgtatccgtcatcgcagggagcgaggatgatattaaccttcgcacccttctcaattccaaaaagggatcattcagatttcttccgggaattatcccggacatgacgactctcgtggctactcttcctgatggcggccgcaccgttctgtccaatgggaccatcctcaagggtccggccatcgacaccatacagaacaccggacggcgcaaaggcaacacgtacactttcgttttcggtagctatcttggcgcccagactgcgcgtcaagccatttctaacgttatccaatcggtactggaggtggtctgatgttagggattttcaccagcctcctaagttcgcgatctttttcgattgtggaccaaaacacaaaccagctagttgctgcggatttgaggataagccgggtcaacacccggttttcttctgtagggcaacgccacatgctggaagatggtacgaccaagatggattccagaacgatccaccctatggaaatcatcgtcgaagtattttgcccttcaattgatgtcgtcgatcagatcaatcaattgctcctggatcgcgacacgctgtacaaagtcatcactcgcggcatggtattcgaacggatgatgtgtaccagcgaagcgctcaatcagactccggatatgatatcggcgactcctgcgcggctgacattctcccaagttctcgtccagaatcccaagcctataatgttcagaaatgcaggggactcttctatgatcgaccgagggctggccctagctgaagacgtggttggctcggccggcgatctgttcgactacgcagtaaacggcgtccagaacgccgcagacttgttctgaggtgccaattgaactctttcctcaagtctattctcaacacgcctactctcaccatacgcgatgatgtcaccaaacttcctgtctggaagagtcttcaagtcaagaaagtggaaatttactcgccggcttccgtagtgtcgaaacctctggcgacgaaagaccagacggaagctcaagtgtacaccgaagctctggacattgatgtgaagaatggaaagatcatccaaccggtgcgactccgcatcaatgctatctgtccggacctgtccaccgttgaaagtatcatgaacgctttcaatgataacacctcgactttcgctatcacttctaagtcgatattggccgataaaatggccatcatgacgctcgatgtagatcagtcgccagacatgttgaacgcggctgagatcaatatggaattcgagcaggttgagcctccagtattgaatgaattcgatcctgcgttccctcaagatagtccgacttatggggtacagattcaatctctttctgatgctaatttgctggatttgggcgccatcggcgattcgatatcttcggccgcaaaatcgctatataatcgcgtgaccagctacttctgaggatgtatcatgcttgaaatcaatcttcccgatggccgtcaaactcgcgtacaaatcgaggcgtggtcggcattggatggctgggaactccagcgccgtttcgtcgaattcgctgtcagccaagattccgacttccgccgctctttcaccatggaaatcctgggctatgcgaaagtgctgcttggcgacgatgacgccggcattccgctgaccaccgcggcagtcatcaacaaccacctcggccactggaagaacgtggaactggttttcaactctgttctcaagcacaatggcatcgacccggccacgcacgccgaccggccggactattgggaacaagtcggatcgcagatggccatcgcatttctggccgaggcgtccaagctcattggtccagcaatgaagatcgccgaaggactcgccaacaagccggagtgattcatgtctagtgatttggatgaattcatacttcggtatgaggccgatactgccagagccgagcgcaatctggagcgcctccagaaccagatcaggcgcgtgaacagcgcatcgacgagtggccttcaggatttgcgccacttcgcagacggcgcggccaccgaactcggcagagtcgttccgcagattgattctgtgacgagcgcaattcgcggaatgaacgcgcaactggcaataggcgccactggcgtggccctggtcgcggccggcgtcaaggcgttcatgaacaccagggaccagtacaatcagcagcgcatccaggcgatggacatcggcatcgccccggcacgcttggaagagtaccagagaaaattcgttcgccagtccggtggaaccatcagccgcgagcagggcgcggagatgaccaaaaatctggcagacactttccggcgtgcttatcgcgatatcgggcgagtcggcccggaagcgcgaattctgcgtatggccggcgtcgatgtcgggagcttccaaaagggcatgcggccgctcaacgacatcatcaccgatctggccacgaaaatggccaagctgaagccggacgaaatttctgcctacgctgatgcccttggcgtctcgcgagattacctgagcaccctggcgaagatcggcccggccatgggaaaagtcactgagatgacgactgcggaactccagtccagggtccagggcgagtccaacatccagaaattcaacgatgccctggcgaatctcaaccagacgttcactaccctggaaaaccgagtcggcgaaaagctcgcgcctgcgttcaccaagctgatcgaaatcatcgacaagatagtccaggctattcccaatgaagtggaaagcttcgcgaaggacaccaaatcccgttgggaagatggagtgctcgggaaggcgaccgttggcagtgatatcctatccctcctcagccccggcgccctgctcggtcgcctggcagcgtgggggactcgtcgcggcatggaagaatcagggctcatcgacaaggacaaggttcccggcgctcaaaccagcgaagacctggccaagaaacaagaagaccaggacaaggctactaagtccatgaaagagctagagaagctggctgaccagaccacgaagtctaccaatgattttgcggtggcgatcaacatgttcagtggcgcggtatcgtcgttcgcgaatgccgttgacgagcgccaagcttgggcagcctgggcgggggaaattggtcgggcggtcggcatgggaagcaccgcgccgacttcgcgggccaccggcgtctatccgcacgcgatctatgatcagtcgaagagtggcgcggccggacaagtcttcggcgagccaatcggcgcccagtctcttcgcaatcgcatgttctcgccgcagcgcaaggcagagccggtcaccgttccatcgtacatcaacgatatcatcaaagatgcttcgaagatgtacaacattcctgagctggacatcaagaaactcatatacaccgaaagccgattcaacgccagggccaccagcgaagccggagcgaaaggcctcatgcaactgatgccggaaatcgccaaggcgtatggtatcactgacgtatatgaccctcgccagaacatcctcggcggaacgcgcctactgcgtgaaaacctagatcgagcaaatggcgacatgcggttggccttgacatactatcatggcggactcgatccgaagaactggggcccaaggactcgcgcatatccgggtttggtaatgagcgctccaatcgagctgatggaagaggctcagcgcaagcagaaggctgcggccatgaccgtcgccaacgagacgttcgccccggaaggcggcgacatggacattcgtccctatgatggcgggcgactggaaaccccagaccagggcaagaaggaagatgagcgccgcgaagcccgtcgatatgacgacagggttgtgcgaccggaaattcgcatcatcgaccgcatgccagaccgcagcgacggcgaaatcctcaagatgtctaggcgtcaagaggccgaccgggcagactctggattccggaagttcccgaatcaggttcgcggcgagaccaagcagaacatccaggcccaactcactgccggagccatcgcgcaagtgatcggcgttaaccccaaccagatcatgcgccgcgaaatcagccgttctgacttgctattcggatacaaccaagccatcctgggcaagcagcaggagatcaaggccgccgcgaccgaagccaacaacgtattcctgtctccagccaagctcgccgaagccactgccaaggtgaacgccgcatcgcgagaaatggatattctcaggacgtacggcgagcaacttctgaagagcgctccagagcgcggccaggagctgaccatcggtcgaatcgatatgttggtcaacgttaccggcgcgaattctccggaagaggctcgcgagatattcagcaagcagactgcagaccagctgactacggcaatccaagatgcccaaaacgattccgcaactaagatactctactgatgaaaaagagaattctgcgagtaacattcaacatgccttatggacccgaagtcatccgagaggatttggatgttcgggtccggatcatgaaggctgcgttgcggattcagaaccgggcgactatggaaattttcggcctaaccactcagctgcgtgagtctcttctgtcacagttcaccgcgtggaagcaccggcaacgtcaagtcggcagggaagacgaattgatgatcaaagtgtcggtggaagccggctactctgaccaggggcgcgagcaagtttccagagtctttgtcggcgaagtggccattgtcgatatcatttcgccgccaccggacattggaatccgcatccagtgctacaccaggcaaatcgacaggacgaagaccattcgaaatatgccgcccgccaacacgacgttcgtcaagttcgtcgagtggggcgcgaacgaaatgggattgaacttcatctgcgataccagttacaacgatcaagttctgaagaatccgggccggtctatcactgtcgcgtcggcaatcctggcgtcgattcaggatatgtacatgccggacgtggccgcgttcgttgatgatgacatcttgatcgtgaaggatcgcgataaagtcattcgccctgatgaggtgaccaacgtcaattcgttcgttggaattccatcttggtctgaatggggcgttgaattccagtgtctgtttgagccatcgattcgcgtggctggaggcgtggcggtcgaatcgctcatgaacccgagcgtcaatggcaactatgtaatcactgctctggaatacgatttggccagtcgggatcggccgttctatatcaaagtcatggggagcccagcagcataatggccagggaaatcaaaccgttcaacatgttcggcgttcactatacttcgcggcaattctctgctgccgatgggctcagcatgatgtcggaaattcagagtgtgccgccagaagaactgctcaagggaaccagtgtattggcgcatccggaagatcatccggaaggcatctggcttcccttgaccgctgcgaacatcaatctttatgtagttgatcgggcgaaagtaatagctcccgtacaagttcttgcacttctgtccgaagtggtaattgactggaactttggtttcctcaaagactggaccggagtcaagattccatccagatttgtcgaagatatcaaaagcgtgaagacggcacattcgccttctgtagttgcgagtttggtagcgaacggctcagcctctatgcgcgagttggaagagtattattcgactcaagatgcatttaagatgatagacatcatgacggcgaagagcgtgaacgaggccttggcgtcagaggcatcgcacaacagaatcaaaaagggataattcctaaccgggcctgggaaggctatactagacctgccaaatcagaggctttcccatgtccaatatttctctaacatcagcaaaagctcccgacagaacgcgactgatcgccgctcttgacgctcggtcgcgacgggatgctctagatttcgaagtaatgataccggctcaggttgttcaatatgaccggaccgagaatatcgcgacgattcaacctctcatcacctgggttgacacggaacacaatgccgtccaaaggcaccagctggtggatattcctgtaatttccatgggggctggcggcttccacataagtttcccgattcagcaaggtgacataggctggatttatgcggccgaccgcgacacgtctcagttcctggagtcgttgtcaatgtcgaagccgaacaccggccgcatccataagttcgagcacggcctgttcatcccggacgtattccgtcgatacaccatcaattccgaagattcggccgctatggtcatacaatcgacttctggagcgaccagaatttcgattcgcggcgataacatcaagataactgcgccgtcgaacgttactgtggatactccgcaggcgaacttcaccggcaatgtgactatcgctaacaccctggtcgtaaacggcatcaacgtgaacaaccacggccacctcgaaaacaacccgcctgatgcccggacgaaaggcggcatggttgcttaaggagattttcatggcaagttttgatttttctgatttaacagcggggggggttgtaatggctaactacaactacatcgtcgatactggtgtgatagtcgcagataccgccgacgttctgagcgacgttgaggccgagttccgcgccgccctcggtgccaatatcaacttggccgcgagcactccgcagggatcgcttgtcgcggccgaggccatcgcccgttccagtgtcatgcggaatgaagcgcgaattgccaataccataaacccgaacgtttcattcggaacgttcctggacgcgatctgtgccttgatggggatcgagcgcggttctgatctgtcaaccttcggctatggagttcaagtcaccggccgcagccaaacccgcatttccaccgggtctagggtccagactccggccggcgcgatcttcacagtgatgagcgatgtcacgatccctgctggtggtgtcgcgaccatcgatatcaaatcgcaggagtatggcaacattcctctgccggtcgggaatctcatcatcatcgacggaacaattggatggtccggagcaaaagtcatcgcctccactcgcgtcgatccgggcagccgccaaatgagcgatgcagagttgaagaatgcccgcgttaatcgattggccatccaaggtcgcaactcgactatggccatcaaggcgtatgtgagcgccgttccaaacgtcacgtcggtgaacgtaatcgagaacaacaccggcgccgttcaagtggtgaatggagtctcgtttacccttccgtatgctgtttgggtctgcgtcgccggaaacccggataaacaagcagtcgccgatgcgttgtgggccgcccataacggcggaactccatgggactatggtgcgacgaacaacggcgtcccggtggacggtccgaatggcgttcctgtgcgcgatccggcgtccggtcgaaagtatgtcgtgaagtggaccactccaattatgtacgatggatatgttaacgtaacagtccagcaaggttcctcctctgtagctccggaagccattcagaacgcagtggtcaattacgcccaggggaaagtggaaggggaagaggggctggtggtgggcgcgagcctgtcggcattcgaagtcgccggcgccatcgctcgcgaaattcccggcatctacatcaaactctgccaggtcgcgtgcgtcgcggctggctcgccggctccggctccgggcgatttcacttcggaatacgtcatgagcgcattcggccaggctaccatttccgttggtaacgttcgggtgactttcgtatgactctgcctgcgtacaattcggacatccaacaagctctgaaatggctccataaccaggcgcctggaatcaccggcctgatccagagaaaggcgcaatggtatgacagattcagccgccaattctgggccaactgggagcgcgacgttttccacttgaaaactgccaacccgttcggccttatggtttggtgcatcatcctcggcacgccttcgaaagggttcggcctttatccaaaaaacagttcttgggcattcggtcggctacgccagaacttcatctatagcggtacacaagttccgccaccggcagacgcatcgcctggcggcaacttctacggtggcggcaatgccgaaattctcaacttggacgaaatcaggaaagtgcttcagctaagatatgtagcgctgatttctaacggctcgattgcatatgtcaatcgcatgcttcgttacatattcaatgatgatgagccatgggacgaggcgaccggtctgtacttctatctcatggactcaaccggcgagaatggccctgtggagaacttggcgatatatcggaaagattgggaaggtatggtgctgttgtccagttcgcccagagcgaaccacgtgctgacatcgacccctgccagcgacgccgattggccgggagtcgatccggccgcgagcggtattccggtaacggtcgaaacggcgtccgctacggccccggacggctccgctacggtgtgcaagcttactaagccggccgggagtaccgcttacgtctccgcgccgatagatgggccgctggggtccggtagcactgtaacgttctcgttcttcgcgaaagccggctccacccgtttcattgcaattcagtcggctgccgatttccccagtcgagccgatgccgttttcgacctggattccgggaacgtaatcagcgatcagatgctggacagcagcgtggtaagcgcccgaatgattcgtctggaaaatggctggtggcgttgcgttctcacgaccaagaccgtcagctcttcgttccgcgctgcttacgtcgctccggcagaaaccaacttcagctggattgattcgaattccagcgcggagattgacgtgcttatctggggcgctcagatcgaactgggtgatactccaactggatacttggaaactaccggggcgcccgtaaccatgaccgattatgttttgcagaacgcccagaccggaacagtcaagttcacacagccccttccgaccggagtagaagcgtattggactggagactggaaaggcgggactgcagcagaaccggccagattcgcagtcgggaatgggactcaggatacgtttactctgtcagaccccgcatacatcggcctacccaccagtggggcgttcaagctagaatacagggttggtccggcgcttaatctgtcgccgcaattgatcaacctcatgaatgaccgggcagttggtattatgccgacttgcgccggttgcgatgtcaaagtcattcaggagtaatgacgtgatcacacccgaactgatccccagtccgtttgccgctcagggcgataaagacccgattccacaaacctcctccactggcttcgcaaaccttcgcgacggctatacgccggactacgaaatcagcctggcgtcgaacaacccgcaggccaaagcggtcgagcggaagattcaaaaccaactcttcttcatcgctacccagaacgcacaggcgtggcagcgacaaatggcgccgccgtggtttcagggcatgcctggcggctacgaacagaatgcagaagtcgtgcgcgtcggaaatgacggcataatgcggcgctatcgttccatggtgaatgccaatgcgagcgaccctctcagcagcacgacttgggaagaacaacccgcatggtcggcgatgcgctccaacatcccgatgccggccggaggcccaggcctatcttctggcggagaagtcatcacgaccggccgcaacttcaacgacctgttaaatgggacgtgggagttcttctctgattcagtggttatcgcttctcagaatgcccccgtatatccggcttccgctggtgccgctgctggcatgttggaggcgaaatcttgggtgtccggagccaatacgttctgcgtccaacgctacactgatcgcgtcgggaacgtcgctgtgcgcgggcttaatgccggagcgtggaccaactggatgtatgcggtaaacgtcatggcccttcaacaaggtcgggtcacctatggagtcgcggccggatcggcgaacgcttacacgttgacgctagttccgcagctccaaggcggcctggtggatggcatgattcttcgggtcaagttcaacaccatgaacaccggcgcctccaccatcaacgtctccggactcggcgccaaagccatcgtcggcgcggccaacttccctctcaccggcggcgaacttggccaaggactcatcgctgagcttgtattcgacgcagcaggcgaccgctggagaatcctcgcaggcgcgccacgcatccaagttggcaacgccgatcaagattaccaggcccccagctggaaacaggtgaaggattacgtcgcgtcccaaaagctgactgaagtggactgggctgacgtcgtcaacaagccgaacgtcgctatccaagacactacgccgtggttcgccaatctggagttgtctgacgctcggcctttcatcgatttccacttcaacaacaaccgcgccaaagacttcgactatcgctttatctctgaagctgatgggtcgatggcgttctactctcgccaggggtcagctggtcctacccaggatatcctgttcagcaggtcgaatgttacattcctccagccgcgactggatgttgcgaaaaacctcgcgtacatcgcgaactctggccccctttggcagaacaccactgccgatcagcctggttggaaattcaccttcgcacaaggtgtggacgccaacaacaacgcggttatcgcagtcaataccaccaatccggacggctcctatcgctcacagatcatgcgatgggactgggcgtccacgaacgtcatattcaacaatcgtccgctctttgccggtcaatacactccttgggattctggaaactttgatccctccaccaagttgactgtgaatgccacgaaccaaatcgccggcccgaccgggattcggaatacaaacggcaacaccggcaacatgaacacatggggctccagttccacgacggcttcatacggaaacgctgctcttcaaatcttcgggaaaggtggtggcgagcctgccgcgctttatttcgacaactcccagacaggatggtatctggggatggacaaggatggacagctcaagcgggccggctggtcgctcggcaataacgcctacgtgattaccgacgaatccaacattcgtttccacgtgaattccatggctggcactcctgtttggggcggaaacgaattctgggggccgtggaactttaatccgaacaccaagctgaccatcaaagccggcacccaggaaactagcagcactgcgatattcagcggaactatgccattcgctccaatcgcatcgctgtccgattattctcaggcccctttgacggtttacaacgcgccaaccggtccgtctgcaaaaccggccgtcatcgcgttcattcgtcctggcaactggggcgcgttcttcggcatcgataccgacaacaagctgaaatggggcggcggatcgctcggcaacagttccagggaaatcgccgattccagcaacatcatgaatctttgggcggccaacccgaccgcgccgtcctggaacggccaaaccgtttggcgatccggaaactttgatccggcgacgaaagtggatttgaacgccgcgaacgccaccaacggcaacatggtcttcaaccgcatttctggaactggtagcggcatagcttcgtcaggtcgagttggcgccatcaacctgcagaatggggcgcattcggggcaagcggcagcagtcactttcgagcggggcggcagtatcttcgtcaacttcggcttggataccgacaacgttctcaaagtaggtggcggaaacctgggggcaaatgcctatccggtcatccacgccgggaactacaataactacatcaaccaggcgctggttcaggtgggtcttggcggagtcggttcctatggcatctttgcggttctggacaatgccgctccaaccgcgaccgttcgaccgggagtggttgtggacggttccattctcatctactcgtcttgcgccgcaaactacaatagcggtcaaaggcctgccggaacttggcgctgcatgggatatgtagtcaaccgggatgccaacactcctgactccgcgacccttttccagcgagtgacgtaaaatgaaatggacgcggatcagaaaccctcgttggctggatgaaacaaacatccacgccatggtgactttcgaggggatcggggaagttcctttcactgccaatccgcacgacgtggaggcccatggaagggccatccacgctgcgatcctgtccggggagcacggacctatcgccccggtagattcgacgcgggagaaggccttgcaggacgctatacgagcaagggaaaagcgggctatccttcgcgatacccgctggcccatagatcgtcacgacgagcagaggcggctgggtatcgaaaccactgacggacctgggctgatagcagctcttgtttcctggaggcagcagattcgcgattggaatagcggggatcggccgcgacttcccatggctctgaaaacgatgtttaaaaatcaggagtattgatgaaaatcacgaaggatattctgatcaccggaaccggttgcaccacggatcgggcgatcaagtggctggatgatgtccaggcggctatggacaagttccacatcgagtcgccgcgagccattgcggcctacctagccaacatcggcgtcgagtccggtggactggtgagtctggtggagaatctcaactacagcgcccaaggattggccaacacatggccgcgccggtacgcagtagacccgcgagtccgcccgtatgtcccgaatgctctggcgaatcgtctggcccgaaacccggttgccatcgccaacaacgtgtacgcggatcgcatgggcaatggatgcgagcaggatggcgatggttggaagtatcgcgggcgcggcttaatccagctgaccgggaagtcgaactattctctgttcgccgaagactccggcatggacgttctggagaagccggagcttctggaaactccggccggcgcgtcgatgtcttcggcctggttcttctggcgcaatcgctgcatccccatggcggaatccaacaacttctccatggtcgtgaaaaccatcaacggcgccgcgccgaacgatgcgaaccatggccagctccggatcaaccgttatatgaagaccatcgccgcgatcaatcaaggctcctgatattcgcccaaaagaaaaggccgcttattcagcggcctttttgctttccggctttgcctcttcaaccatcttgacttcaaccggcgcggcggactcttcctgagtgaccgaatccacatagttccctagtgaactcagaacgccgattaacagcgctcttactaccttgtccttgactgtctcgcctatgatcttggtcagaacggatattaactcttcccggagtctggggctgattcttggccgaaagcgcttgcgatgctctttgcgtttcatgtttagtcctctgtctgcggtcttctcctcaccccgataatggcttggggatgcgctgtgttaatcggaaggttcgggcgctattataactcgtcgaaaatgctcgcgcttaactgtttaacgatacgcaccgcgatattaaatcgccttctttctggccaaggaactctggcggccgggtccggtctaaggcctaatttgtcgacattaaaacgagaaaacccggatcgcctgtagggcaatgcgtccgggtttatttctatctagtgtacgctaggatcagtgacttccgccccacccgtccagccagcaatcgaagacggcgtgcctcggcttgtccttggcgccatgggagaagtgcttgaaccggatgacctggcccttgagatactccctgtcattccagcggcgctgtttctcgtcgtgggtcaggctggaggccgacacgttgaaagtgactccaggccacagacgttcgttgcggcagactaacgcaccgaccattccggacggcgacaggttttctgcgtggctggagcgggccgtgtggccaagttcattgatgaaagcttcattgttgttgtgcatcaactcttccacgtcgatgatctcagcttcatcgtagtcgtatcgcttgactttcacacagtgcccttccttggcagtcgagcgaccgaacttgtacagcccatcagcgcgcttgcccatggaaccttcgaatcccagcattgtgtggcggcgctcgacttcgctgaactgttcgatggaagtcaccagttcctgctcgaccaggtgaatcctctcatagccgaggcagtgacgaaggaagttcacgcgctcggccgccctggctaggcgatcttcggtcggtgcgcgaggatcggtgaaatcatcgaacacatggaaagaccagtccggctcaccgctgtggcggcgaagatcgccggacgacttctggaaaactttcgggtcgctgatgtcgccgcagaccagctcgccgtccaggccgttgaacagtttatcgctgaggtattcgtagatcgattgattgttctgccgcttgagttgacgagtcagcgcctcgccttcgaatacgaagcagcgaaatccatcgatcttcggcgagaaatacatcggcagttggccttccagcagcttcgggtcaaaattcgatgcgagcatgggtttcatacagttctccagaaaagaagcccggcgaaccgggctaaatggcggtaagccggctcagatggtttcgttggcgtggttcagttcggccatgatcgacgcatagcgctcgtccgactccttgatgaacacgccgtcgtacatgacgcctttgcgatccttgatggtgtcgtaggccgcagcgtagcaggcgagcatggtagtgtcgtgctcttccgtcacatcgaacagagtcatgacggccaataccaggctcttgatggctaatccatgatttccgcgtgccagcgcgccggccagatgtccgaggtgctgcaaatcgtcgccgtaggtgggatgaacttcgacagtctcgctgaagaccgatagatgatcgaacagattttcaccgagttgcgcggccatgatcgtggcaaccaccattacgtcgccgatgccgtctttcacctcgactggtttgttataaacccaggcttcgcaaacttctgcgaactcttcgaccaacttcaggaattgatccttggccgaagagcctttgatcaggttccggtcggaaccccatttaacaaccaggtcgtgaagttcgcgactcatgatttgttcgatattcattctttcgattccttttggatttgggattttactgcgttgattatggacgccgtgctctggcgcgatccatccttggtggtgccgaagtagaaggccattaccgacttcagctcggcgaaccaatagccgatgatggtgccgatggcgaccgaggatgttgggtccatcagagcctcgcggccgaatgtgaagattgcgatgatgatgagaatggagcctgtcagaagagcgaatgtaatcgccgggcgaacgaaatcgttctgctgcgccgcaagcctcctcgcagaatccctgtcggccgcctctgcggcgaactggctaagctcggcctggagctggttctgctcagactgaaggcgattttgttcggcttgaatcgcaagctcctggagacgaacgcgctcggcgctctggagttcggcgagacgcgctagagcttccggattcgcgtctagagcgctagcgaccgaggctgggtcggccttcgaccccagcgccgtcgcgacgatagcacccacggcggcgcctgcaggcccacccaggagcgaccccagagccggggcagccgcgccgatcttactacctatgtctttccagtccatttcgactcctcaaaagaaaggcgccattacagcgcctttctccggccggtgattcagaactcttcggcttcggtcgcatcgccgacgccaccggcgtcactgcgaggctgttcctgcttgctgtagtccaccttcacctcgccgccgacgaacgacttgtacaggtcggccgcagccttgaagtgatccgggttcttcaccaggccttccagctcgaactggacgccggaccagctacccttgtcgttcgacatgcctacggtggtcatgcggaccaggttggcgaaagtcggcggggtgcgcaggccctgcggggtctgaacctttttctgggacagcgcggtcatgagcttcttcgaggccttgatctgcgaagacgacagggagatcagagcctggccgaaatcgccggtgtccggatcgatgacgatgacgtaatgaccacgggtgtcggcgaagtagtcagacttcttgtcgctgaccgaaccgtcttcgttcggcgcgtacaggcgtccttcgacttccttcaccttggtcgggtctttcatcatttccttgaagtcttcgacgctgatggcgcccttgaaaccgccctcggcctcgcgaccggcccagcggatgaactcgcggcggtacgcggccggaatgatcagcaggccggtcttgccgtcgtaaatcttgccggtgacggtgttcaggaacatgccggccttcgcgccttcgatgtacttcgggtcatcttcatcgacctggggagacatcttctgcagaacctggatgaaggggatggcataggactcggcatcggcgccttcgaagcctgcgccgtcatacgatcccaaatccatgaagtcgggaacttcggtagttgcgacggcgccgccaccggtggcaactgctacggccttggtttcttcggttgcttcggaagtttcggttttcttaccagccatgttaggctccttgtttgtcgaatttcagttatcgctaactgtgggtttataataacggaagttgcaactaagtaaagcaaattacatattaagatttgctctttttcatcttcggtttcgtgatcttggcctctttgtattcgtgcacgccgatgaaatctggcagctcttcgcccttctccagatactcgcggccgaacgcctggagggtctggtaatggacatcgcggttgatggtggcgtcatagccggcttcgatgatggcctcggccgccttcttcgcatcttccatttcgccgcgaccgaactcggccagaaccttggtcttgatgatgccgtcgttgtctgtgtcttccagccacttccagaacttcgatttgttctcttccttgacggaaatgatggccttcggctcgactttgaccgtgcgaccgtccgccagagtagtggtcttttgaccaagctcctccaacagctccggaatggtgttgcgcttgagggttttcagctcctcttccttttcggccagcgccttttgaagatcgaggatttcgacgtccagctgcgaagccttgtccaccaggttcagcagtcgatggccgatgtcggtagcttcgaccgccatttcatccatgacgccaaaatagtcgatttcgcccggtgcgttctctttcaggtattccgggatttcaagctcttgctctttcatgtccgcctccaacttagtgatgttcccttacttgaactaagtattgagtagatattatgccgcatcttccttgatacggctactgatttacatattaaatttcgtcgcgagtgctaacgtcagcctcaaacactccatcaacgacataacttgccaggttgcgcttccactccaagctgacctggattttctcgtcgatggaatccagacagatcaggtcgaagtacaaaaccgagttgacggtgccgattcggtgatttcggtcttcggactgcatccgcaactcgttgtcttcgtcggtcgtgtagtaaatggccacgtctgcggcggtgagcgtgatcccgatccctgctgcggccgggttgcccaggaacacctggacgcgcttggcctggaaatcgtcgatcaatttttcccgctcggcctctttggtctcgccgtagtatgtgccaaacgaaattccttgggcctccagatacgccttgatctggtcgatttcctgaatgcgcatggcccagatgatgatggagcgctccgggtcttcctccagcagaccctccagaagatcagtaaacacggcgaatcgcgggttgtcttcgggcggcaggatcaccggctcgccatagacgttgatatagccggatgcaacttgcttgagcttcgaacgcgctgccgcagcatcgaaagatacgtccagcatgaagtcttcgttcttgagaacgaagtggtagtcttcttccacgcgctggtaaacttttcgttgctccggcgacatttcgaagtatatgcgcttgtacaccttgtccggcaggaatgggagtgcttccttcttcgtgacccggaaactgtgcggctcgatcagggaccgcagcttgtccaggttccggaataccgggcgcccacgctcgtctttttcgaccagttgcggcggcatggtttgcttcccttccagcttgcgcatgatagcgatcattcgaggatcgtcactgggaaccaaaacggaaaattcggccacgaacgcccgataggatttcgttccaagaattccatcgcgcaagaattggaactgcatgaacaaatcggtaggcgcccgcgttagaggagttccggaaaggatgcgacgggccacggccttctcacccagctttacgatctttttcgcacgcttggcttgcgggtttttgatcctcgtggactcgtcaacaattgcgcaaaccttgaaagtttcaaggaatcgcaagacttcatcatagccagcctggtgattgatggcgtcaacgttgatggcgaagacgcgaagaactttttcatctgcgaacgtctcggcatacagacgatccaagcgcgccctggcctttttggaagtcggtcggccgcgccaatccacgctcaaagtcttgatcgcgacgtgggtgggaatctcgcgcagaatccagttggtgtggacgcccttgggggcgacgatgagcagcgcgtccacgcgcccctgtaggaagaggcgaacggcatcggccaaagtcgtccaagtcttcccggtgccctgctccatcaggtatgcgaaattccgtttgttcagggacgcggccagggcattgaactggtgctgcatggcctcggtcttcatgcccttgacgggatatgttttggctttcatttgttctccaaatcggcgaggaactgaacaatgttatccagtccttctgcatagctcgcaatttccaccaagtcgcggctgttaagctcgaacaaatcgagcatgggattcagcagcagccaatcggtcccgatcttggccaggacgaagccccggccgccccagccgatccgttcccgaaggaaagggatttgcccaggctcgaaacatctggccattgggcaggtggaggcgcgtttcggccactcctccaacgccttgaactcgacccagaactggacacctcgacgattcaggcaaatcgaatcggacataccagaccgccgcgtctccagaaagtcgatcaggattcggccgagtgagcgttgcttaaacgcattcgccgctttcgtttcgcgatcattcatcgccttcgccctctttggaaactttctctgcttgcgctgccagctttgctttttcgcgttcggtcaaaatcctcttgacggccttcacgatgaacatatcgattccgctgagcttccagcctttgatgaggaaccaagagcctgtcggcgttccttcggcaatctgctttccgtattgcagatatttttcaggcctaattctgaaacgtatcggctgatcaaccgagtcgtcaacacacatgatgtcgaggaactgcgactggcccttgtacaccgggtttttcccttgatctgccctcttcttctggcgaatcggttcgttctcatcagacagaacttttttcaccatcttgacaatgaccaggccatcgtctccatcgcggatatcccgaatgttctggatggggtttccggaagttactccaaccaactccggattgtcataagcatgaccccagagcgtgtgagcttcgttcaaatctgcgaattgaacttcagaattcgacagactcgcggcgactttctcccaatcctgaagcgtcttcaggtgggttccggccagctctttatattgagctttcagctccctaagatcggcctttaactccttcagatcggccttcaacagtttttccagttctttgtcttggctgattttcgccgaaagaatctgggcttccagcgctgctacatcagcagccttgtcctcaacatcctgtgccgatatcgggcaattggccagggcgatcctcgcggccttgacgtcatcacgaaggcgcaggaacttctctgccttcgccgggccgaagcctttggcgttcatgatgccgccgatcaggcgcccgtccgccactacccagttaagttcggaatgctccgggtccagggccgtatattctacgccttccttggccaattcgcgaaggatggacacagtttgctggtcgtctttcgccgcccgaagacacgctgccgcgtattccaggcgatgataccgcttcatgtagcaggtccagtacgtcaccacagcgtagctgaccgagtgggagcggttgaatccccaggcgccgaatgtcaccatttcctgccacacacggtgagcatcgtccggggcgacgcctatggtcttggcaccctcgatgaacaattcccggcgcttgttgaagaactcttcaccctttcgcgcagacatggctttccggattgccgatgtctgctcccagtcgaactgtccgatgtccttgacgatggacatgatctgttcctgatataggaagacgccgtacgtccctgacagatattgctcgacctgcggaatggtataggtcacaggctcgcggccggccacgcgctcgatatacttggtggccataccagaagacaacggacccggacgggctagcgccgtgatgtggtcgatgttttcgaacgcggtgatattgatcgcgtttgcgaccgaacgaactgcctgcccttcgaactggaaaatgccggacattttgtcttcgttgagaacatccaggaccgccttgtcgttcaaaggcaagtcgtacaactcctgcgcagtcacacagttcgcgtcctggatgacgcccagagttcgaaggccgagcgcatcgatcttgaggagattcaaatattccgaatccggcttatcgagctgcgcgacgccttcagaagttaccgtacagaagtcgataacttcatcgttgcagaccaggatgcctgccgcgtgtacgccagagtgggatgggtgaatttcgaggtcgcccatgcaggcggacgcgatctcatacttttcgcggaagtcgcggccgggctgagttttctcgaaagtgtcctccaatccttttccatatcgttcgtccgccgacgtatattcaatgatcgagtttttgatgttgtctgtatcgtggaaggggatgccgaagcgctttccgacgtgagcgataaccgacgcggccttgagcgtgttgatgttgcccaacttcaccacgttccaagtgccatacttctgctggagatattcgaacactagatagcgatgggtatcggcgaagtcgatatctatatcgggaagatcggaccgggaaatgtcgataaagcgctggaagagaaggcgatgagggagcgggtcaacctcggtaatgccaaggagatagcagaccaaagagccggccgaagagccgcgagctgggccgaccagcatatgcttcttggcgaacgcgaccagatctgccacgaccaggaagtagctgtcgaaatctttcagctgaatctgcttgatctcttcttggaatcgatcctcatactcctgggtccattccttgatgtggccgcgactgagacggtaggcttgcccctcgcgagccagcgcgacgatatccccatccaggtggatcataggcgccttcgccagtttcacatccgccaattgttcgactaccgcacgagtattggcggcggcggcatcgaactcttcgcgagtcatgatgtggcgtaaacggctccacaactcctcttcggtggcgatgtggcgaaggccgaccgattcccgcaccttccaggccgacgcgaaatcagcatggtcgatggacggcatgtcgttgtaagaggtaattaccaccggctttccgaatgccctggccgtctccatagcgccgtgcgcggcgaccatcgacgcgggattgatgtcaatgtagtcgattccggccagatccagatgggcataggcctcgccagcgaatttgatgacgccgtcagcttcctggaattcttgcggagtcaatccttgattctggaccgacttggaagtcaagcggtagaacttctttgtgtccttggcgagcacccaggctttgagcttcagctctttctcgccatcgtcggcgcatttgatcgggatttccatgccgaatccgcgaggcagttctgccttggtagcggcttgctcccaacggacgtggccccatgttccatcatcgacgatggcgacgaatggggattcgatctctttggcgcgctcgatgatctccgggaatcgaccatatgcggcgccgtaggagtaaccagagcgaacgcggagctgagggaaagacatcatgcggcctccattgcttgatacgcccgatacactcccatgcgcttgcagacttcgtggagcagccgcacgtcgtcgagcgcccggtgtttctgtacatatgggccgcagtagtgctcataaagatgttgcagccgcatgcggtggccgaacaacggcgccgactcttccacagtacagatatcgagcgatgggaaattgacttcgtccaggccgaacttgccgcgagccagatcgcaggtcagcatgaacttatcgaatggcaggttgtgggcaatattcgcgtcggctctggaaaagaagtcgcgaactttctggcgctgatcgaggaaagatgggtgcttgaccaggtcttcgttcttcaacccggtgatcttggtgatgatttcctcgataacgattccaggattgcagatgaactctacttcatccaaaatcttttcgccatcagttatcacgccggcgaattcgatgattctcggctgctttctcagactcaccctttggtggaacgggagtcctgtggtctcagtatcccatacagcgaatatcatgtttgttccctcttatgtcgaaaggccggctgctttcgcgaccggcctgaggagtataccgcgacggctgaagatttacgccttctgtccgtctttcggcgtgatgcggccggagcgcatggtggcgtgaacaaacgccgaatagttgatcgagtccaaggccgaatcggcatccttgaacccgctattcgccaggcgagtgagtttacccaccatgtgcatcacgaacagggcgagtcgatgatcatcggcggtcttcgccaccaggccgttcgggaagaggatttccatgatctttccgtacatcagatcattgcgaccataggtgctctggcgggcgcggaagacttctgctgcggcgtacagattgttgagaacatcttccgcgaaatcatctggatgggaatcatcttcgcccggccagacggattccatggcgaacggcgcggcgtcttcggtcgggtctttggactgagccgtttcagcgagcggagacggggctttcgcaaacgcctcgtcgagggtaggggcggagttcggggcggccgggaacggctcgcctgccatgtcgttgggcgcgctatcggggtcgctatcggccgcgacggcgaagaacggcgcatcgcaaccttccaggttcaggatgtaggagtcgatccccaggctattgtaggcatcgatgatgtcctggcgatcatcgaacgccgcgacgatcttggtgacgccttcgattttcttcaggatgtcgagcgcgactgcccgcttgaactgaggcgccggctcggtgttaccatacggccgcatgatgagttcatactcgcgatgttcggcgatgccgagttcgcggtggagcttggccctggtctggaaaaagtggttgtcggttcggccggtgacgaagaaaatcatgaggtcggcgtcgatggcattcctgatgcgacctacagcgtgcgggttgagagtgtccttgtcgagacgagaatgatactcgtcccattgccgttccaaggcgaagctcttgcggtggctatcgtcgaatacgcagccgtccagatcgaagatgatgatgccattcttgggtttgcgttccatattcagatttccttgatggttgctttctgggtgacggttttatcgatgaacgtcccatcagaagtgaggcggaaaacttcgccattctggctgaaatcgaacgattgcacgttcatcgtgatgcgaatggattcgctgccgttggtcacttcgacttgtgcgatgtcgccaactttctcgacaatgatcttcatgttacatggacttcccattaacggccacagggctggcctcttgtttttccgatccccagaaatcgcggcgcagttcttcctgctcggccgagcgatccatccaggggcgatagaacttgcactggtaaatcggctctaccggcaaattaaccacaggaatctgaccgggcttcgtctccagagcggacatgaagcggtcataggatttctgctggatttcctcttcattcatcaccttcgatccataacgcgggaaggcgcaggagccggtggcgacgcagtgcggctggagcaggctgtcgaacatcggatagacttccagcaccagccggcgcatttcgcggaacgcttcctgatattcaccctgggtccgaacgcacaggcgaaccttcgccatgtcgctgagagtccgcaggttgaacttggccgcgatcttcgtttccatgttggaagggatgatggcacgagcatcctgaagcgatgcgccggcctccaagagcttctggtaactggtctgcgcgtcggcgatggcatcgtgccacaggcggttcagctcttctcgggcgtgataggtcgggtccggctcgccattggccgtcgccggctcatcgaaatcccagcggaatgcttccggttgaactacggcgctcacctccagggcgcgactggtttcctgctggtaagccccggtgcgagtccgaacgagttgatgggtgaaattcttgctgacgccctcgatctggaaaatgaagtccacgaactcgaacggcgagcggatggtgtccagcatgtacttccagtggtcgagcttttcggcctcggtcatggtcgccgggtcttggccgcgcatgcgggtggacttcgtgcccaagagcaattcccaggcgttctgggtgtaactaatcagagaaatcttcatcagaaatcttccggaattggcgtgaagtggaatttttcggtgagagccagggccaggccttgggcttgctccctgttaaggccatactgctctatctcttccttgagcagttcgcaggcctccaggcgcgcctcatactcttcagcctcatggacggatgagaagacggctccatcagaggttcggtacacaagttcgatcgccatggtgacctcagtagcagcggatgatttcggcgcggatgtcgcgacggtcgaggtagtgctcacgaatcttgtcgcgggcacgctcggcctcttcgcggctgccgaacgacaggttgaacgacgtgaaaggcttatcatccagttcagcgccggtctgatacaggattcctaccagaacgaaagacggcgcggtcttcggctgctggtcggtttgcagttcgagaaaggacatagggagacctcttcaggatgatctggtgcgtacattaatagcgctcctgctgagcagctacggtttccggctcatagatgagcatgtcaacgatttccgggcactggcctttcacccagtcgatggccgcgaccagtgcggtggaagcggagaaagagaaagtgcggtaagactcatggatgtacggcgaccccatggaatcgcgctcggtggtgcgcgaaatgactgctttgatattaacgatccggcccatcttcggcctccactttagcgattatatcggacaggcttaacttctcgccattcaggaaataactggcgcgaaacttcctgtcgccctctggcccgacgattcgggccgttattgtgagactcccgccgccaagggcatcggtgtcccggaagaaagctagcagcgcccgcttgagcgctgcttcgcgaggatcgacggccattaacctaccacgttccagccgtgctgagcgcaccacacggcaccggtccctgcaggaagactattcagaaggaacacaggagtcaggcggccatcctcggtcatatggacgaagtagcgggcgccttcaccgagccactcggccttggcgatggcgcgttcgagattggccttggtggcgtaggtcttggtgtggttcttgtcggtggagaaggttacttcgcgggccatttgtcgattccttttggttgaagggtttcgcgtttcgatgagggaatattacgcccacctgatccagaagtaaagcacttttgtaaattacttcacgaacattttcttggccttctgataagacgaagaagtcatcaggcgctcgatgacgtccatgtcagaaaccagatcgtccagaaggacgttgcgccaggtagcgaaccggccgagcgagaagatgccggcttcatgggtgagattccagatcatggattcgcgctcgtcgcggccgagcggaacgattttgcctttggtctggatggtcggctcgccgtcctcgatgagatgccttttccttatgccgaaggccgcgcaaacgtaatccacatcccagtcgctgtcccattcgatggtttcgattttaccatctaaagtctccactatccccttagtgatggattcgacgatcagagtatcaccggtgatggacgctcgaaacgttcccactttaggaccagggaaatacacggtctggaagacatcacaggggatggaaagcttgtatcgactcacgatgatggaggttccttcaccgaatgacgggtcgattcccaggtccagccctgccgcagccagattggcgcggaacggcgcggtgctgatgatattcacgtggtcatcttgccggcgaagatactggaagaaagaggcgtcgaaaggacggctccaagtgatacgattcgcaagcttagccaccagctgctcatagtagtcggccggtgcgatccaacgcttttcagtcgccagattccagatggaccggtccgacaggccgcccgttactttcctggagtacatgttgcagtggtcgatgcgcggctgggaaatgaactcgccgtcgatgtagatagctttgtgtacagtgacttcgcggaacgggatgccggtgagttggccaatcactggcgagcggaatcgcagaagtgcgttgtggcgctccttattctccggcgtcgccgcgtcgatgatttgggcttgaggaaagcgatgcgcggcgatcagtccggcgagtccggcacctacgatgattactttctgatcaggaatcatgatgtgtcccttatgagtgtacaaaacttgagaggataaaaaagggacccattttcatgagtcccttgaagagctagacgattcaggctcagaggagcggcggcttactcctcctcaccttcggaaccatcggcgccctgatcttcaccgtcgtgctcctggccttcgtcatcggccttctcgtcatcgccctggccagcttcgtcttccttcgaagcgatggcaaccagatcgacccagcccatgatttccagcttgctcaggtagctgcgaaccgaagtgccatagagcagatgggccaacttctcgccgaaggattcgatttcgaccggctcaccaacggtgcagtgctcgttgatgtatgcgaacaccttgccgcgagtcgagaaggcctgcggagtgccatggccgtcgccggtcgggatgaagtgggtggcgcgcggacggcgggagccattggacttcaggtcttcgcggcgggcttcggccttcttgcggcgctcttcctgctcttccttgcggcgctgcttctcggcttcgcgctcagccttcttctgctcggccaggcgcttgcgctcttcttcgcgagcgactttctgagcttcctgggcggccttcttctcttcggcctttttggctcgctcggcttccttctcggccttcttctgctcgcgctcggcttccttggccttcgccttctcggcctgctcggcttccttcgccttggccttttcagcacgctcggcttctttggcggcggccttttccttcgccttctcggcgcgctcggcttccttcttctcgcgctcggccttgcgcttctcttcgcgctcggctttcttctgctcggcttccttggccttggcttcggccttctcggcgcgctcgcgctctttacgttggcgctcagcggccttctcggccttgcgcagggcagcggcttgttccttggtcagctcttcgccttgggtctgttcgttctggtccttctgttccatgttcttactccgggaatgtttaaagggatggcttattggcctgtgagaggattatctctaaactaattgaagaagggaatacccttagcctgaactttcctaaatattttctttcgggaaagtccaaactctagggaacttatttatgttcgagaagttcctagcttttacgcaagaacagtaagtattcgattgcgcgagttatcccagtatacatcaactgactataagggatggacggcaagttttcttccaacatggcgacccgtttccattccgatccctgcgacttatggaacgtcatcgcccagccgaagtcgaatccgccaatggccttctgcgcctccagccgcacatcttcctcgaccgaaaagctcaagggattgaacttcacccagcgctcatagttcgtgccgataatgcgaactttggcaaacagcatttcatccggctcgtcatcatcttcttggccttcggggaccggcttgaagtccagcagaattgcttgctcgccgttcatgatgccatattcgtgctggttcccggtgcacaccagcttctcgccgatttccggttgtacacccttgtagccgaggatgcggcgcgccctggcgttcaaacggcggcgagtattgttgtaggcgcaaaggatcacgccatcatcgtccaagaacgtccgcatttcgtcatccgacatgtcgaatccggcccgtaccagaatgtcgtcatactcgcggcagggtaggcgcttgccctggcggacgaacatcgacgctcgaacgatattgccggcgttgcgctcgatttcggtcatgatggtgtcacagctgttctcatggaaaatctggacgccgcgcacaggaggaacttggccaaagtcaccaatctccagaaccggaattcggtgcgacagcaagcgctcttcatcccactcgccgatcatggacgactcgtcgagcacgaccaacttcggcttctcgtcgagcgagtctttgttggcaaacatgatttcgccgtcttcatcttcgccaatcggccgatagatgaagctgtggagggtccgggcattggtgcaacccttctcgcgaagccgcgctgctgctttcccggttggcgcgacgaagaccgtccagtccatcgagcagcaaagttcggcgatgatcttcgcgatggaagtcttaccagttccggcgaaaccagcgagtcgatagacctggcggcggtgcgctcgatcacaccaaccgcgataccagtccacaacggaattgatcgcgtcgatctgctgactgtttggtcgaaagccgaatcgctcttcgatctgatcgacggtgaagttagatgctgacatatttgcgttctccaacgctaggtttaattgaatcgaggctcagtttaagcacgccgtccacagaccagccagtatcacgacgatacttgcggccttgcggatcgacatagaagttcttcgtgcgccgcagcagaacataatgccaagcagctccaagtgcgtggacccttcctttatacgggaaagccttcgcctgctctgcggcctctttggccccagggagccagcggacggtcgaaaggaccaggaccgcacccttaatagcctgggaagcggcgcggccgtcctgtgggctatagcgatgtctatcgaagtctacccagtggtggttgccgcgccggagcttgaccgttcgggatcgcccctcgaacaccaccgtgccttcatgagtaaaaatatgttccgccatcgaatgttcctttataacatacagttatgctttacctctgcgcaggaagagtatactatcagctgactcgccaaagcgagcgaatttaatccaactttacttcggcaggaaagtggccgatactagcgccgccgcctgtactgccctccaaaacagaggatacattaaatgcaagaatgcaagatttcccgcgaccaactcccggtcggtaatccgaatcccaatgtcgacaagacccgcgacccgaacctgaagcccggcttccttcgccgaagccgcgagctggacccggcgctggccgttcgcattcgtcgcgagctgatccacgccgaagcatccgacttggccaaggccggatgggtcaattcacagtccagcctttatggatcgaaagccttcccgcgccattccgtcgttcgcgtgaccggagttccggaagatggagctttcatcggcatgctgatcggcttcatcgagcatcgcgagcatggcgaatgggcggtcatggaagccggaacgaaagaaggcggcgccgtcatcatcccggtcgatcacatcatgcgagcgtcattcgccgaagccgaagagttcgccgaaaagtgggagcggaacttgggatggcgcctcctgcgccagctccgcgagtgcggcgccctggccgggactgaagacgagttcctgcggcggatcatcaatcgatacgttcgtgatcgcacgatcctcgaccaccacaaagtcggcgctgacaaaatctacactgatgcagtgctcaaaagcatcggcgaaacatggccgaagattccttcggggaaattcgtcggacaccgagtcgcgcaactcctgatcgaccacaagctaggtcgagcgggaaccattctgaatgacctggtggacttcctggagaagttcgcggccgggcgcgataaagttctcaacatcgccatctgtaattgaggtgaagggatgaacaataaaccgacgctgaatcaccaccatcaaactgcattgttgtatctgtataacaatccaaatcagccggccttcacaggtcccaacaatcaggcgctcaatgaacttcggcagatggggtatgtaaaggcgaaagaattcgaaaactgggcaggcaccggccatcttaggatggaatggacgctcaccaaagccgggattgagcgcgtcgaagtcgggcttctggggaagtgcgacgcttgcaagggaatcggtcagactttgcttcgggggaagtgtactgtttgcaatggccgcggccaggggtggatcagagaatggtcgcagaagccaatcgaagataatcctcaaattgtccctaagttcgaaaagaccgatgcgaatagacttgcagacgccattgaagaaatcggccggctggaaaaggcactggccgaatccgaaaagcgcgggagcgagctggccgcgagctattgtgacggcgtagtcggcgatgaatacggccatccttattgtcgttataaagtggaacgcgacgccgccttggccgaagtagagcgcctgcgagaatcaaaaggcgatccctctggcagcttcgacagttgtatgaagatgatgtacgagcgcgacgagaatgcaaaacgactcgacgccgccttggccagggtcgcggagctggaagggaagttgacggactgggtgcacgaagggttccggctcaacgaggcgctagcggtcgccaaggctcaacccagcgtgccggaggggtggaagctcgtaccgatggacccgacatcgcagatgacctctgtcggtcagtccctgcgttatgacgcggtaaacagcatcggcgagatttaccggcaaatgctcgccgtagctccctcacccatcgatccggccgcgcatcctcagccgtgccagcaaccacaggcccatcctgcccgctgcgggtgcgagcggtaagtgccaagcaaggagttcatgtaatggaacagcagaaaccttcgaaagtagatggagccatcgccatgaccgatctcgatattcgcattcttcgaaaggcgaagcccgaagcgcaggacgagtgcgccgtgtccatgttcgcaacggcgatccgccagaaactgcagcgctcccgcgataaaggccgaggcggctggatcgactgcgacgaagatgttctgatcaacggattcgccgaacatgcgctgaagggtaatgagaacaacctcttggacctggcgacgttcctgatgttcatgtgggtgcgcggcatcgacgatgcgaagattcccccggcgctcgaaaaggcgcggcagcacaagatcatggaagcatggagtcgggtccacgaagatggactaaactccgccagaaaggcgagtgctgcgcgacagttcgtggaagtgcctcgacgcaaggggcgcccggagcgacttgcatgaagcctcacgaaataagactggcacaggccgaagagttcctgcgcgaactcggccgagggattccggacgacgagagggtgatggtcggctacgctgaagaggccacagtccagaccgacgagaacggccgcaagctcaacgccggctggtggcctgtgccctggaaggaagggaaatacatcaactccagatccaacgcctacgcgtgcatctcgtcgtccatcaagacgcccaacccgaagaccggccagatgcgatactggcgcggcgaagcctctttcggccacggcctggcgttgatggtcgatgacatcggctcaggcaaagggtccaagggtgacttcgaccgcgacgagttccgcgagcgactggagccgaccgcgattgtggagacttcgccgaacaactaccagttctggtatttcttcaaagagccgatgtcccacatgctccagttcaaggcgctgctctattcgttcgtggaccaggtgctaaagaaaggcggcgacaacaccgtcaaggacgtcagccgttacggccggatgcccttcggcttcaacaacaagcgcgggaaagacggcaagttcaaatatgccgacgaaaacggcaagcccgaactcgtgcgactgttcagcgccgactattccaagcgctactcgccagaagagatcgcccaggcattcggcgtccgcatcatcatgccacagatgaagaaggtggagataaaccgcgacgattgggtgtatgaccaagtatggctgaagtatgccgagcacatctgcacgaaatacaagatgggcgaagcggcaggcggccaggtccagcagaatatgtccggcaaataccgcatccgctgtccctggggcgacgagcacaccaacggcgatcctttcggcgcatactttcgcggaccgatacctggcgccgagcacgaatatgtgttcggatgcgggcacgatacttgccgcaaagagcatcgacggacatgggcggccttcactgatgaagtcgtcctgccctatatcgtagaacaattggaacgcattaaccgccgtcacatcggcgaggagtagtaactatgcaaaatgatcctggaattctgattaccgccatcggctcattgctgctcggccttctcgtcttcttcgaaggcctgaatggctggaaaataccagtgtcaaactttctcgcgtcgctcttgtgcttcttcgtcggcctttctgctttgacgttctggttcgtcgttgcgtttgacgtattttaatcgacgaacggtacagaaattttcggatggggacggaacttattagctatgccggtttaggtaggagataatagccgtccctttcgcctcaatgtgtagaggcaatgttgaatccgatcatgtaaagcagaaggcggcaaacctaacatgattatcgacgaagataatatttttgatgatggcgaatcagggtccagtgagtttgatctcacgcagatagaagatgctggaatggaccctttgatgaccgccgcgagcaaggcggccgatgatgcgattgcgaggaacgaaacgcatcgcgcgcaaaaggcggcaagatacgccgaggcgtatgctgaaccagacttgaggaagcgagcgcggttgttgatgctcgaccaggcgttcgatcttccggtcagccgggtggtgaaagggccgttcgatgacttcatcacgaaatacagctcgacgtcagacagcaactacctcgcggtctatgatacgttgttctgtaagggcgacggaaccgtcccacacccgcacttcgacgagtttcgcggccggctggtggaccatcgcggcgtggcgttcaacaacaagaccctcgatccgattgacctgatgggcgccctcgcggctgcggccttggacgatccctcgattaagaagacgattgagacttgctgcgtttgggcgcgtcgatatcgccgcaactcgctgatcgagacgtttgagaagaagataccggattgggacggcgaagagcgaattagcacgttgctgatcgatcttttcaagccgttcgacaccgaattgaaccggatggtaagcaagtatttctggctgagcttgtactgccgcatcaactaccctggaatctcggcgccgatctcgttggcgttgattggtgggcaggatgcggggaaatcatatttcggcttgctgatctgtaaggagctgtccggtgggcgcgatctggctccagttcagctcgacctgagccgacacgaccagacgccgttcctgcgcaacatcaccggcaactcggttattgcgaacgtcggcgaaatgtccggcttcaaaaagggcgacatggaacgcatcaaagaattcctggtgcgatcttcggatacattcgaccagaagtttgagccgggcgaaacgatcaagcggcaatggatcaccatcatggacggcaacggatacgatggactccagcgggacgactccggcaaccgtcgattctatccgatgttcgtggcacaacttcccgacgaagatggaaagccgaactgggttaagccgggcgatggtaatgaaccgttcaaggtggacttcaccgacttcggccgcaaattctggcaagcgatggctgaatgccgcgcatggatcgaagagcatggtgtcgatggatacctggatatggtgtcggaagcgaaccgcgaagtgcagaagttctctatttcggaaatggagaatgcgcgtggcgtggttcgtgatgacacgattgatatgtatctgatcaacgtgctgatcagttgcgagttcgaagagatcaagcctggcaggaattcaaagaatcctggatggagagtcaacaccatcgaaatcctgaaatggttcgatattctcgccaggaagaagccgatttctcgccacttaactccgcacctgaaggcgctaggatttgttccgaataagaatggcttgaatggatggtgcctgcctgtagataaggttgcacctggatgggcgaatgacatgcacacgacgctgccgccgttcaatgatgcgcttgtgtacttgctgaggaaggtggattctgaggtgactgatgaagaggcaatgattcaaatccgcaaagttaaggccgagcgcgcaaggatattgggcgaggatttctgatgtagtgatggagtgtacttggactaggccgccttcgggcggtcttttctttggtacggagtacattcgatttcggttgtggccgagtgagattcggaagctatctggtaattagggtttggtggcgatggcgcgttgtggaaagttcgtggacggtggatcgaggattttgtgtggtgattggatgaattgtggaaaatcgacgattctgactggattttttgggtcggccgcgtcgagcttaccggtaatttacgaaaccggtaattagggcctagccttagtgccgcgtgggtttgaagggcttaaccggatactttccggtttcggatgcagccgcaaaagtatactacagcgaaaatcgattgcac

SEQ ID NO: 21 - DNA, 66392 bp, Myoviridae Pbunavirus
  misc_feature (1)..(66392)
aatcctaatagaaaaaatctatcacggacgttacctatctttaaaattaataaaattaatagtaatttggtaatttggtatactttagtatttgaaagccttgcggcactaagcctgtacacttcccgtcaagtttccgattccgctcaactcgcggcagggtcgccggaaacttccagacttacaatccatgggtcgcggcaacaccacggcggactaagcggcaagcgccaaaactcgacgaacggaaccggaaatttgggagcgcgacagaatcgctcagctggacatatttctaacattcgatttaacactcctcccaaacactcaccaccatcctcacccaccaaccgccgactcgatcctcacccaccagcaaacctcccatataacatcctataacaccacctaacactcattcaccatcaaacccacccagacctacaggccacccacaagcagcccatagacgcgatccctggccccatagtacaatcgcgccatactcagtgtcgcggcagagcaccaggggccatccgccaaccaagccaccacgacgactccagaatcgaactcagggacgcagcaccaaatgaccaaattctacagccccgacgatctagtcacgccacaggaattcgcagacccgcatttcgcggcgatcaaccaaaagcgattcgacctgtacatcgacctgcgcgtccaaggttacagctcctggcgggtcttccgggccatctggggcgaggagcatatggacggtcccgcgcaggcccgcatcttcgcgatggagtccaacccgtactatcgcaagcagttcaaggccaagttgaacgcgaccaaaacgtccgatttgtggaatccaaagacggcgctccatgaactcctccagatggttcgcgacccaaccgtcaaggattccagccgtctgtcggccatcaaggagttgaacgttctggctgaaatcacgttcgtggacgagtcgggcaagacccggatcggtcgcggtttggccgacttctacgcatcagaagccgaggctcagaccgcgaccgtcgctgctgcggccgaagccaatggctatgtgccggaaggtgaagagggagatttcccgtctccgtctccggaaccgaccgaggaagaccgcgccaaccccatttagacataaaataacatcgttctaggcccgaatcggaccgaactaaggcgaaggtagcgggaagggacgaaaaacgattctagggcggttctaggaagtcggagcctaaccctcagaaacgacaaagcccccggactctagctcagaatccgggggctttcttttgggcgccttattcgccagcttcgatgatttcgaagttgtatttgacgccttcgtgctcgaaagtcatcttgccagccgccttcagctgcatgcggaagcggatatgtttcgaagaaggcaggccgaactcgatgaatgctgcgttggtggaccggaactcgccgcgcttgcctttgacagtcacagccacgccatggcgctgagtgcgtttcttggaaacttccgggtctttccaggagttggcgatggctgccgacaggtctttggactctttggctttctccggagcgttcttggcctcttcgcgcatcttccggatttcttccagcgcttcctcttcggtgatctcttcttcaggcttcagattctcttcctcggccttctcttcttccttcttcttcttggaagtgcgggttttgtagactttggccggggcttcctcttcctgaaaggcttcttcctcggccggcagagcattcaggatggcgaggcagcgacgctcagcagtcttgcggtcagagaaacgcttgacggtcgcatcggcgttgtgagcgttgtagaaggcgaccagttctttcatttctgcgttctggatgtcgccgaaggttttgatggagttggtcattttgcgatcctctgttttggaagatttcgtttgggcttcagtttgtcgccccgttgaaagagattatgcctaggtcgatgctgcgtgtctacatttattttagcagaatgatggtgaacccgacgaacggttgtcgggtgtgaaaacaccgcaggacgaggctgcggtgttttctggacgatggtgcgacggtcagaaagtcgggatcggctcgacgggcagatcgccgggcttgtcgttgtccgacgcgggcgacggactggacgggatggccccggaccgaagccccagcggttcaggccgcctgcttacctgcggagctggaggcgcaggcggagcttttggtgcttgtggaactttcggaactggaggtgctggcggagacatcggcccttctggaagatctggaagatctggaaggctcgtcgccgcgtgatcgacgccaacgaatggctctggaaggtcgatgaggctcggcaccggatcgaagcctgtgaatggagtggtcacgcagcgcatgttcggatgggtcggcagattgttcaggacgatggagtccgcccagacatacgggtttttgtggttgccgggtccgtggctgatgatctcggcaggaatatggccgttcatggtaagccattccgccatcccttgccgagtcagcgggcttaccacgatctgaccagtggactctttggcgatggcgaacagatcaccgaattcgaatccgatgattgtgtagttggacctggactcgccgacgaaagccagggtttcgatgttgtggtggatatcttgttcttcccagatgtaaagcatgatgcgctcctcaataaggctgcttgctgtattcgaccagagacataccggccggaactttgaagcggacgtattcgatcatcatcgccgtgcgacgccgattcgtgcccgactcgtcattgacgaatagttcgcactggtgcggaatgactcgcgtcaccaggcactcacctttcgagctgtagaacttgctgtaggctgcgacgcctcgcgtcatgttcagacggatcgtttcgcagagtcgctgcgcggccgacgcgctggacagatcggtcggactgaccgtcacccagtaatggccactttgttctttatcggacataagctgccctccaatgagaaagcctctgcgactcggcagaggcttgttgttgttagtcgcgcttcaacagaacgactttgtcatatgcgcgatatttaccgcgccagtcttcccagtagtcgccggccgggcaggtaagctccaggttgatttcgtcgcgccagcattcgacagaaaggacaattgccttgttcctggctgcggaatccgccctgagcttaatcagaatttcgtcgccagttttcaactcatcaactcttacaacttttgccatggtgttctcctattgggcagcgccgcgagggcggatcgggtcgatgtcatgtaagcagatggtaggatagtccctggccaacttgagcttgaagtccacccagtcagcgccgatgagtgccgagacttcgatgcttactttgctgtgcggcgcagctccagatcgcaggactatggcccgacgccgaacgggatcgttgacgtcaacatgagtgagtatttcgtcgccgacgagcaactcacaggccatcaatattttggccatcatacactcctatgagaaggcgcggccaggacgatcccagccgcgccgatggattaacgtttgtgaaggatggacactgcgtccacgtcgaggatgctaatggtacggcgacggcgcggattgctgcgttcatggatgcgaatcaggttcgcagctggagcttcgtccaccacccatacgtcttccggtttctgcgtccggagcaggaccgtcacttcagtattctgggcgaggccgttgcagatgaaagtgaacttggacgagggagttctgtacatttcgagattcctttttggacttctggtccggcttctcagccggtgaagagattatgccctgattctcaccgccgagtaaagcatttgtgtaccaattctcccgtcaggtggaaccaaagtgcggtatcgcttatggctacgctaccgcgccatggcccttcttgctcgcacactgcgaaccacaggctgatttccatccttgccaggactcggccgaaagattcgaacctgcgccgactggacaggatgtcgacattcactcgtcgattgacctcataccggcgaccgttgatgacgaagaccagccgcagggtttgtccgtccagacattcccagtatctggtttcataccgaagccagtagcgctttccagccgggcctaccatggtcatttaatcgatgctcctggccgcgccacgcggtccggtcggcgggacgggatcgaaccgacccaggatgtagtcgggccggcgcgcttcctgaggacacacggcgagaaggcgccatcctgcgtccagggcagactggagttcgtccgtgcagcagtcttccttgagcagcagacggttgacgttctggagattcggaccaggtatggccgatcctgtgagtgagttccaaccctcgattccactcaccatctccggttggttgatgtagcttacggacataccggccaaccggctcgcggccagctccagacgctccagcatgggtcgcagagcagcttccgggtcaatgtcgtcccagagaaggaccaggctgatgatggtatacggatagtccttgtccagatcccaggctgaagcggtcaggcggcccaggccgatttcattacacataacgggaacgtcgttgctccaggtggacggctcccagttccgctcaccaggattcccgattgttacgccttccaggttccccagtagaacatggagcttgctgacatattccgcctccaaggctttccgctcttcgtcggtctggttgtggcgatagaaggatggagggctgactttggcatggtagagtttcataactgttcctcggttttggaagatttgaaagttagagaatggtgtcgcagtatttctcgaaaggactctggcgcttcttctcgcagatcgcgcaggtgatttccaggtcgggcagctcgctgtaagtcttgccgagatacagccagcgcttgcacagactgcgaccgtccgccatgaagaaatggactttgcgagcgttgccgggttgcgcccagccgcttggtgccggcttcctgctcataccatcaccatgtcgatttcgctggcgaagaagttaacgccgactccatctgcgtagccggtgtaacgcagccgaatagtaccatcgatgtgggcttcttcgacgccgatgacttccaggatggtttcgtcgcagtgcagcttgacgaacatcttgatgccggagccaatcgccgcgaaggcgatctgcttgtacaggtcttgcttgatcatgctttgcgctcctgtttgcggatgtattctgccctggcttcggcttcgaacttcgcccaaagcgcgttgtcgactggaccccagggaccggtctgagtcccgtccaccggcgcgaacttgccaccggcgcgacgatacttggacagcgttctcaggctgatgattttctcttcttgggaatcgaattggacgatcacttgacatacttcccgaagtagcaggtgtggaggatttccaggcccttggagatggccttcagcttgattccgaaattcttgatcgcccagtccagatcgtggtgatagaactcgatgatgttgacgatttgaccggcgctgtagtggatgacgcgaaccttgccgttccagcggaaatcttcgcggctgtttacggcctcgactgcgatggtgtcgtttctgccgatggtccattttgagctagtcatgtcgcaatcctctttttggagtgtttcgcgtttcgatgaggtaactatacctcagcaacttcattgagtaaagcacttttgaacagattgtctaaaatttctggaagacaaatcaatcggccgcgtcatcgatagcgaacgccgatcgcgccaggtcgatgatctctggccatgtcaaagtaaaggttttgccgtcatcacgaatgataattggagtctgcagcggctcgcccaccagcattgtgtaggtatgtttctcgccggatgcggagccgatgcgggtgcttaaggtgagcggggattctttgtgtacggtgccgatcatcgtttcgttcctcggtgatacccggagaatcgggcgcgttggattaggctttgccgcgacggattgttacgccgcattcagtagtcacttccttagcggcaggatcgcgaacaagataagcacaggcggctttgacattcaaagctcgggttgcgccgagtttgcaggaaagatcattcccctcttcgtcccacagatgggcaatgcgagagatacagcccttttctacttcagcttctacagttacggactggtcaatgttaaataccggcatcgctttctctccgagattgttccgtttcaatgaggtgactatacctcagcaacttcattgagtaaagcattttcttcagattatctgaaaccttttgaagtcaggaactgccgccagagccagtcgatgtgttcgttgcagtaacgctcgccatcggacgacatagccagagcaccatccttgatgccgaaccgggtgacggcgagccattcgaactcgaactggagcgttcctgggcgagggatatggggacatggcgtatttctgcacggtcagtgatcctcagaaggtttagcgtttgcgatagccgctactttctgcataccgaggcgatagaaatcggcttctttcctggcttttgtaagctgctccatggcgtcgcacgccgtcttgtgctgggcattggcgttcttgatgctgccttccaggctcttgtccagctcttcccggagcgccttctgcgatgctagctctgcctccaaatcctggattctgagctggagctggcgatttgtctcgccaacctggttttcgcgggcgatggagttctgaaggcattcgtcaaggcgagtattttcgcgcaccagctgatgcttttcgactttcgcctttctgcacgtctctcgcatttctgaaagctcaatcgcatgcagatcgtcatccgggtctttacgctcttccttcgactccatccgcaggtagtactggccggctgcgaaggcgagcactgcctggtcggcatacgctgcggcatcggtcatgtatctggatttgtagcgaggcagaaacttgcactcctctggatcccagaggagactatcggcaataggccagaatttgcggaagccatcaggatcgacttctacattgaccatttgcagctggccggcctccacttcgacttccagaggaacctgaatggcgccggtgatgtactggaagtacactatgctagacataacacaatcctcataagaagtcgcggccgggaccatcccagccgcatcgtaatcactcttcgccttcgtccgcgctcagccactcttcgaaggcgaaatttaccttagactcgacccaatcttgaagctcatcggcgaactcgtcactgtcgatgtccatcggaatgcccagagtctcttcgttccacagttcggcattcagttcgaactggatagccggttcgccatccacattcagcaggatgcggtctgcgacttcatattcgtcgacatcgaagaggaaaccgccgctgatgatgtgctggatgaaagcttcgtcgaagttgctgatgccgatattgatctgcttagtcattttttctggccccttatttggcgagtttgtactgagctttgagggtggtcagcttagctttcagggcgatcatagcctggccgcgcaggccttccatttctgcctcgctgatggcgatcttggcggagcggatttgatcgttgatctgggatttggtcatttctgcgttcctctgttttggagtgtttcgcgttcgatgaagagattatgacgctattcagaatggaagtaaagcagaattgtgaaatatttctcaaagtggacgaacggtatgccccgtcaggaatatttcctcccatggaaggcatttccgcatccgaatgttgattaggtatcccaaagcgcgcagtggcgaatgtgagtccgcacgtacatagggttgtattgtgcgaagtgctcgacggtcgcatccaaggctctgctattgccgcacccttccgctttgcgagccaggaagaatgcttctatttgctggtttgcgttcatcgtcttaccctccaggtgtttgttcgtttcgatgaagagattatgccgttggtcagaatggaagtaaagtgtattaacaataaaattatgttcaccgacgaacggttgtgctcgaccgtccgttgcggcgtcgatatactcgacctattgctgacaccggattgattagaatgtacaaactcaaccctgcactgcgagcggtctggcgaactcgcgcccgttacaaagtcatttatggcggccgggcgtcttcgaagtcacacgacgcaggcggtatcgccgttttcctcgcggccaactacaagctaaagttcctctgtgctcgccagtttcagaaccgcatcagcgaatcggtctacacgttgatcaaggacaagatcgaaaactcagagtataatggcgaattcatcttcaccaagaactctatcaagcacaagagtaccgggtcagagttcctattctatgggatcgcccgtaacctgtcggaaatcaagtccaccgaaggcatcgacattctctggcttgaggaagctcactatctgacccaggagcaatgggaagtcatcgagccgaccatccggaaagagaactcagaaatctggatcatcttcaacccgaacgaagtgaccgacttcgtgtatcagaacttcgtggtcaagccaccgaaagattcctgcgtcaagatgatcaactggaatgaaaatccgttcctcagtgagacgatgctcaaagtcattcacgaagcatatgagcgcgaccgggagcaggccgagcacatttatggcgggattccgaagactggtggcgacaaatccgtcatcaatctcaagttcattcttgcggccatcgacgcccacaagaaactcggctgggagccggccggatcgaagcgcatcggcttcgacgttgcggacgacggcgaggatgcgaacgcaactacgctcatgcacggcaacgtcattatggaagtggacgaatgggacggcctggaagatgaactgctcaagtcgtccagccgcgtttacaacctggcgaagatgaaaggcgcctcggtcacttatgactccatcggtgtcggcgctcacgtcggatcgaagttcgccgagttgaacgatgccagtcccgacttcaaactgatctatgatccattcaacgcgggcggcgctgtcgataagcctgatgatatctacatgaagctgccgcacacgacgatcaagaacaaagaccacttcagcaacatcaaggcgcagaagtgggaagaagtcgcgacccgattccggaagacttatgaagcggttgagcatggaaaggtttatcccttcgacgaattgatttcgatcaactctgaaacgattcacccggacaaactaaatcaactgtgtatcgaactttcgtcgccgcgcaaagacctggacatgaacggccggttcaaagtcgagtccaagaaggatatgcgcgagaaacgcaagatcaagtcgccgaacatcgctgactcggtgattatgtcggccattctgccgatccggaagcccaaaggtttcttcgacttctaaacacagaaaagcccggatcgctccgggcttcgggtcttactcggtgtggttcctggcgctgagtgtcgacgcaacggcctcgccgactcccagggcttcctggccggccgcgagcgcttcggcttccgactcgacgatgaagtcatcaccttggccgtcgcctggcggaacctcgaccagcacggcttcttcgccttcgaaccgcaggtcataagtcttttcgacggacagtccgtaacgggcattgagcgcatcccagagctgagcttcatagttgcgcaggtcttgcagagatttctggtggctgagcatcgccatatcgacggcccgttgcagggtttcgtccaggacgttgaatcgcatgcgaagagaacgaatccgctcgaccacttccgcatccactacatgtctttcgatcatcgcttttcacctttgctgaatgttacgttgtagccattgtcggccaggtaggtcagggcgccttcgaaggaagttccgacaagatgctttagctgcatttcgcgttgcgcggcgatccagaatgccgttccggagaactctgcgcggccttccgacaataccttgccatcaggcccgtcgatccgaacgtgaacggaagatagcttcagtaccatcaatgaatccctccactggcttgcgacggcatgctttcagcgcgagcggcttcacagtccgggcagggacaggcttggcggacgcgctccaactcgtcggcatccatgacatagagcttcccatcggaagtgtcgtgcgccatggcgatgttcgggaagtcggcagcgctcaggccggcgacagcgcggatttcgtcccagagcgccacatgctcggcattcaggcgagctgcgagcgcttcgtgctctttcgctacacgagccatgaactcgtccatccggaatgcgaattccgcatcgatggatcgggccgaggccatggagttgaggcgaatcggttctttcttcatggtaattctcttttggctgggggtttgtggtctacccaggcctattcaaagcctgggtagcatgatgctgaagatgaacaagaaggctgcaaacgccaatagcgttcctgtgagtattttggttcggctctgcagctcagcgtactccttggttgacagcccttgctgcgccgcctcggccgcgaaacgagctttcgcctcgataacttccgggcgcagcgacaggacatattctaaggcctcttcccgcgctttttcggcctcgaccgacctagggtcgcgggccgagacttcgctgtgccctggcctcgcgggatgggcctgcagcgatggaggaagttcagcagccacgactccatagtcggcgcaggcccaagcgatcccgatgaggatcgcgaggatggattggacgattcgcagcatcactttgtcgctagggaagttcataatcaatcctccaccgaccgaacgatttccatattgcgcccggcattggcccctgcattgaaggcgcgccgaccgtcgctatcgtccagacgcatgagcttcgtaacattggacttcttgtagccaggatcgccgaaatgttcgtgaaccgcagcttccttcaccaccaccagagacgttccggcagaagataccagctccatacgcttcctggtgatggactgaaggcgatagctgatttcctgggtcgcggcgagcttgaattgcgcggcaaccttgacgttgaaccgttcgaatccttgagctttctgatactcccggcacagacgatcaacggcctcgaccagggaattgaacatgttcaccgccagctccacgtccgacttgtagcctttaaagcgaacggcatggccccagcgtttggtggtgctgccgtcgcgggcgctcctggacgccttggccgatgctcggtgattgttgacgccaccggcgaaatccatgatgcagtcgttgtacgtcgcaacggccaccgagaagaatttcatccaattcgggattgcggaatagtaacgagtagcgatttgctcgtcgaactcttcgcgaatctcgccggccgcttcgaagtcgtgaagatcatatttgtccttcagcttcttcacgcgctcggcagcgatggccgcttcgtgcggactggaagagtcggccgccatggcggtcagcttgcggatgcggtctttcgctttctcgatggcttccggggtgaattcgttctggtcggtcatgttacgttccttttgtctgaagggtttcgctttcgatggagctattctgccttcatccagaatggaagtaaagcattttcttccattatttcggaagagcctggaaataattccaagcccagtcgcctgcggccaggacgaagatgatgaccgcgaagaacgcgattgcagcgaccagttgcgcgcccggcttcagcttgggatggctgagcttgggctctacgggagcgcccggagtgctggcgctggaaccggcgtctcctgggccgtagccgattccacgttcacgcgcctggagcgacaccagggatttcagatactcggtctgcttttgcgactcttcgtagatgccggcgacggcgaaccagagcgcgaacactacggccgtgcatatgacccaggcgccggtcagcaggagggccagcggaccgatgaggaagacggaagcggccaggacgatggcgccgccccagatgatgaagccggccagaccattggtgatgtcgatacagaactttttcatttttcagattccttcggttacgggatggaggggatttggaactctgcgccgccgagaacatcaatgacgacttcccagagcgtcggaacagaccactggtaacggtcgaagtcggtttcaggatcgacgcccagcgtcacataggaagtggcaggccatttatgaacactgcctttccgcatgagagtcgccacgcggccgtcaccgagcggattcgtcctgtgcggaacgtacgcagacatcgaatattgctgcccggcgtcgacaacaaatctttgcctctggcgcagacatacagagcccacaggattccagccgcgaccgccgcaagcctggcgagccgaagaatgctcataaccttcgtgagtcatttcgccgaggcaagccgagcgatcctcgtaatagttgatgttctccatcgatccaaccagcaccagagactcgaaatcgaatcgatgatcgtggatggccgagtgattgaagcaaagccgacgcggcagctccgggtgccaaacatggaggcgaccggccggaagttggacctgaatgaaccccaggccgtgcagagtgatcttgtccttcatcgggtcatggacggtgctcatggataatcctcagtagcagaaatgtattgtgagagttacgattgacaagccggtcgcccatagaagggcgaaccaggccatggctttgatggtcgtgtagatcatccgaagaattttccggcacagatcgggccaatgcccatttcgatggatgcgtggttggtcaactcgcgaccgcagcaggagcactgaccagtcttccgaccgtaggcgactgccgattccatcggcttttcgaacatcttcagaacgtcgtcgtgctcagtatcggtgcagtcgcgactcttgatgaatttgccattggtgatccggccgaggtagatgtcgcccaggacgtacaggctaccggcgttccggctgtgagcgctagcctctttcacaacaacgatgagcggctcctcgccttcgccagctaggcggattttcgggcgcttgataccagactctttcgccttctcaaacgctttctcgatgccggaaatgtccagagtcggcgcagcagcttcctgcgcggccactttctcgcgatacttggcgaggttttcgatggcgcgcttcgcagcagcgatctgattttctgtcaaggagccgtatttatacaacgactcctgaaggctctgagcgaagctgaaggaatttccagtccaccactcgatgatgtccgggtgcgcggcttcgaaggccttaattttgaggtcgcgctcttgcgcagcgctacagattttctcgatgcgcttttctaccgccttagcacggctcttggcgcgctgctccgggctggttttatactctttgtatccgacgccgccgcaggcaaagcaggcgcgaccataagacgaagggccacggtacaggccggtgcctgcgcatttggtgcacttgtcgcgatacagcttcacttccttccgggagttcgggcgggcacccatggacacgtcttccagggtcttcggcgcttcgttgttgatctctacggtagcgaagtcatcacccaggtcttcgaagccggtgaacagattctctgctgcgttcatgtcgattctcctgtttggaaagttcgtttcgatgagttgactatacgccagaaatggaaaaacggtagagatttctcactaccgttcgtcgggtcgaagacaatcaataaatgtcgctattgatcttgaacccatgctcagcgccgtcgttgtagtcgtactcagcatagctgtcgcagtagtcgttcaaatgctgaatgatgcctagaacgtcgttcgcggccttgtgccgtttcgcggcgatggtcttggcgatgctgtcgccgacttccagggtttcggccgtccggcgatggatcagcagacggctccaaagatagagccggacgcgacgaatgatgtctcgatggcgctccagtcgtccgtgcaactcttcaatttcttgctcgcgagatttcactactcgtcgaagctgctgaacttccagttccaaatcggccttagtagccatgttcacctcaaaaaggaaaatcgtctgggactccaggaagttcgacgattattgttgagcctgatcgatccagaatgcatccgaccgagccagccctgtggggatagggtctacacgaactataacaggtaacttccatgactattcgccaggtcgatcctccacaccatctacagactggtgggcgcttcgacttcagttttcgttcgtccaagacggcgcgtctgtcgcatgaaaggcagcgcgccttaaccgacgtaaccatgggtatagtcgatcattcggatgagaccatcatcctctgattccctcgacttcagaccgcccaaagagtccaactggccgttgcatttcgcatcgatatccatcgaagacaggaatcctgccgatactgcggtgatatcaactttgtcgccggccttcttgaagtcttcgcactcagcatcgagggccacaattgcactcgcggccatgttcacatgactgatgaggtcggggaagatcacaggaacttcacgcgacatgccacggaccgtcagcttcaggactacatacttcatactcactatcccttttgtatgtgaggaaagaacttgctgttttccggatggtgaaaacgctcggtcgcaggcggtctttcttccggacattgaatcgtcgaaggcgggaaaaccgcgccggcgataatcgccgcgaggagtgcagcggatgtcgacatccagagggcggtttccaggctcacccgaacttccggacggcgcggcttcattcgctccaccctcttcctggctcataggatggcagaccgccgccgcgaatccaattgtcccacatacggttcagaccagtcggtggctggggcggcggactgtagaatccgggagtctcagtgctgctcaggaaataaggcgtgcaaacggcctggacgaccaattggtgccgctcccacatcttatcaatcgctcttagcatgacgtcttcgcactgagccttactgtcgaaccgtctgctagtatggtccggcatctggacgcagccgtctccagtgcaaaggaaagcagtagcaatccatacggtgatactcgccatttcgtcaccctctttagttgatgagcagagtctattccatctgctcgccaggagtaaagcgcttttcgtcgggataaatgccgatgatgtctgcgtcaagcatccaaatctccacggacggatcgtcgctgctgatttgatataggttgtacagctcccgtccgccgacagcacgctcgcctcgtggctcaaccgccagaaccttgccgtgtccttctccgtgctcgtccaggtatatgacgtgatcaccgacttcatagctttctttcgtgacgaggcgtgaacgcgagctgttctgcgattccaccatccaggaatccagcacgccgcctttcatgtcgcgaaacaatcttgccgatttgtcgcaatcgaatacgcccagaacttcgccgtctttcaacacgatatgtacgattggcaaaagagtattcatgtttaatctccattggttgataattagagtctaatctgccgaaaagttcccgtaaagaattattttctcataactgattagttgcaactgttaatctgatgtatatgtttgaatctcttttgaacgtttgatgtttcccctataataagcgcacacagtcaacaaccacgtggaactacaatgtttaaactttcctggatattcgggcgcaaaaaggataatgctgcctgttcggaatcggcgccggagaaagtcgcacaaatccctcaacacgatccgctcgaccccatgatcaagctgggaaggattcgcggctggaacgtcgagccggagaaaaccccggtcattcgtagtgtgaaagatttcctggagccgggcctatctgtagcgatggatagtgcgtatggtgatggaccaactccggccgcgaaggctgctgcgggcggccagaatccctatgtcgtcccgactatgttgcaggactggtacaattcccaagggtttatcggataccaagcttgcgcaatcatttcccagcactggttggtggacaaagcttgttccatgtctggggaagacgcagcacggaacggatgggaactcaaatcggacggcaggaagctatccgatgaacaaagcgcgctgatcgcccggcgcgacatggagtttcgcgtcaaagacaaccttgtcgaactcaacagattcaagaacgttttcggcgttcgtatcgcgctgttcgtcgtggagtctgacgatccggactactacgaaaagccgttcaatccggatggaatcacgcccggctcctacaagggaatctcccagatcgatccatactgggcaatgccgcagctcactgctggctcgacggcagatccgtcttccgaacatttctatgagccggatttctggattatcagcggcaaaaaatatcaccgcagccacctagtggtggttcgtggaccgcagccgccagatatcctgaagcctacatacatcttcggcggtatcccgctcacccagagaatctatgagcgcgtgtatgcagcggaacggacggcgaacgaagccccgctgcttgccatgtcgaagcgaaccagcaccatccacgttgacgtggagaaggccatcgcgaacgaagaggccttcaacgctcgcctggcgttctggatcgccaaccgtgataaccacggcgtgaaagttctgggaattgacgaaggcatggagcagttcgacacgaacctggccgacttcgacagcatcatcatgaaccaatatcagctggtcgcggccatcgccaagactccagccacgaagctcctcggcacttctccaaaaggattcaatgccactggtgagcacgaaacgatttcttatcacgaagaactggagtccattcaagagcacatattcgacccacttcttgaacgccactatttgcttctggcgaagtcggaagaaatcgatgtgcagctggaaatcgtctggaatcctgtagactccacgtccagccagcaacaagccgaattgaacaacaagaaagccgctaccgacgaaatctacatcaactctggcgttgtgtctccggatgaagttcgcgagcgtctgcgcgacgatccgcgttccggctacaaccgactcaccgacgatcaggcagaaaccgaaccgggcatgtctccggaaaacctggccgaattcgagaaggccggtgcacagtcgacaaaggcgaaaggcgaagccgagcgagccgaagcccaggcgggcgccgtagagggcgcaggcggcccggttcccgccgctccacgcgggactaagcctctcgcgaaagcggccgaggaaggggccagcgaggccgctgaaccgccgtcgaggccggaccccaaggccgagctgcggaacttgttggtcgatcttttgtcgaagctccaagacctggacgacattaaggcgccggacggcgtagacatagagcacaatgatgcgcctggcttaaagcgcacatccaaacctggcgtgtctggtatggagccttcggtgttttcgtccaaccgcatcgtcgggcctcgtgatcattcggaactccagagaatcaaggtgaatggaataaccaccttgatcgaaaatccgcgcggaagcattcgacaaggcaaggatgggagttggcgagttcagatgaaacaccactacgggttcatcaagggaacgaaaggcgctgatggggatgaagtcgattgcttcgtcggtccgaatctgggatccaaacgggtcttcgtcgtcaaccaagtgaacaagggaggtcagtttgacgagcacaagtgtatgctcggcttcaacaacatcaacgatgcgaagtctggatatctgtcctgcttccgtccgggctgggatggtctcggctccatccatgaagttgacctgcccgctttccgtcgctggctggcgaacggcgacaccaccaaaccgttcgggggcgagtgatggcattcaaggcctccaaaaagcgcgagcgccgggcacctcttccagtcggaagagggaagcccataattccatcggcaggaatcgaggcctggtatcgaaagcagatgaaggatatgtccaagctcatgatctccgactatcgaaacgagattgagaaggcgctgtcccagcctgcggccgaacgtttcttcgccagagacgaatccgttaacgtcctgttcaagatgacccttcgaagcctacagcagcgatggagccgcatttttgaaggtttcgcggccaagatcgccccggagttcgtcaaccggaccgaagaagccgctaccgccgcgacccttcacagcttgtcggtggccggcgtcgatcagccacgagctgcgtataatgagagcgtcaggaacaccctggaggccgcaaccacttacaatcatactctcatcaccaagatccaagaggacgtccacgagaagatttacacatcagtaatgctgtctctgacttccccgaatccggaagagcaaggaacttccggcataactaacgcacttcgcaaagtcgggaagttttctgaagatcgaatcgaactcatcgcaagagatcaaacaagcaagctttacagttctctgagcgatgagagaatggcggaaaatggagtcgaggagttcgagtggctacactcttctgccggcaagactcctcgccacacccacctggagaaagatgggaagaggttcaagctgaatgaccccagactttgggagggtccgaaagcagaccaggggccgccaggatgggcgattaactgtagatgcagaaagataccagtcatttgacatcgataggagcgctatatgccgttagttcatggcacttccaatgaggctcgttctgaaaacatcaagcgggaaatcgaagccggtaaagacccaaagcaggctgcggccatcgcttattccatccagcgcagtgagaaagggaagacggcgaaagattgttcgcctgagctcgtcgccgatcttcgcgccctggtgggcgctctgtcgaggctcgtgaaatgaaccgcaagacgtgccggcgccgactcgtggtcgatgtaatcagggccaatattcacggcggattcttcagcctgaagtttgccgccatcgatttggcaatcatcggcgtcgccatcttgatggcttttggccgataatgctgagaaaaatctggattctgactaaaaattctagtccggatagccgcaagttaccgtttacggaaaatagcagtaatttggaaatcctactgccgcgaggctttaacagagccagttcctaatttccgatttagccgcatgcttcaaaagtatatagcctgggaaattagaagtaacgttccaatagaattcatctataagtaacgttataatataacgtcaatctatatgctctagacgtattgaaattcaatttttaatcggtaaattggtaatttgaattagtttaggagttgaaagcctcgcggcagtaggcttagacaaatcacgtcaagtttccgagaccaaattaccggattttcgcggctgaggaaactggtaattagatcacaatacaaattataatgtaagttaacagtcacggctacatctaattattgttccgcttatttacccttagatgtactgcgtatataatacagccatagtccacgactcttcgaattaacgatggcaaagtcgaaaagaaaaattgacgaaaatggatatatgaccatagagggctgcccgatcagctcttatggcgttttccaatattctgctggtcaactcggtcttccgggcgatccgacgcggattgtcaacgtatatcgcccggagtctgccgtcagcgatccggagtacatcgaatctctgaagaatctcccgttgatcgacgagcatgagatgctgtcgggattcgacgatgatgacgatagcgtggcccccgaagacaaaggggtggagggcatcatcacatccaacgcttactacgaagccccatgggcacgcggcgatatccgcatctattcccgcaacatgcagaatcagctggaaaggggcaaagaagacctgtccctaggctatagttgccgctacactgagcaacccggcatctggaacgggacgccttatgaagtcgtccaggacaagatgcgcggcaaccacatcgccctggtaaaagagggtcgtgtgccgggggccagagtattggatggtctgtgttttgaccatctcagttttgatttcagaccatccgatgagggtaatgaaatgagtctcaagaaagccaagcggaagccccctgtccagcgcgtagggcaagctgctgactcggcggtcgaagagttgcgcgccctgtggccgaagctatctgcgtctgtccagaagttcctgggcgaagaagagcaggagccggagcatcaggaaggcgcagctccggccgaaccgaccgacagcgagcacctgaccgagcatccgactctggaaggtgctcagaaggatgacgaagagcaggaagaggagccttccgttgtcgatccggccgtggccgccgtcgagccggagcatcaagaaggtgccgcatccgaaatgtccggtgaaggcgaagtcgccgaactgatctctcaggtcaaagccattctggctcgactggagggcacggtagccgaaggggcagacgaagagcatggcgaaggtcaagatgtcgtcgagggcttggaggagcagagcagcctcagcggctcgcaaaccgccagcgacgatggtggtgagagcaaggataacagcgaggaacttcctgaaatggcacagaagaacgcgcaagatgctgcaattcgcggtctctatcgcgacattgctgctaaagatcgcctctacaagcgtcttagctccgtggttggtgcgttcgatcaccgagctatggactcggctgaagtcgctgtttacggcgtgaaaaagctgaatatcagctgcgcgaagggccaggaagctctggcgctcgacatgtacctgaaaggcgtcgaagcctcgcggggcgcggccagccgtcaatcgaaagcccaggattcggccggttctgctccgcagtgcgccgagctggacagctacctgaagggggagtaactcatgttccagaaacaagtttaccgccagtacactcctggttttccgggcgatctgatcgaggacggcccgaagcgggcgcggccgggtcgaatcatgtctctgtctgccgtaaatccggctgccaccgccaccggccccaaccgcatcagtcgcgctttcggttacgccggtgacgtcagctccctcggcgaaggtcagccgaagactatcgcggctcgcgcttctgaagtcgtgatcggcggcgccaacttctttggtgtcctcggtcatccgaagcactatgcgctgttcggttcggccggagactccctggctcccagctatgatctgcccgatggcgccgaaggcgagttcttcgacatggccaccggcctggtcgtcgaaattttcaacggcgccgcaaccgccctggacctggactatggtgacctggtcgcctatgtaccaaacaacctgcctaccgccgacaacgcgcttggcctgccggccggcgccctggttggcttcaaggctggctccatgccgaccggcttggtccagattcccaacgcacgcatcgttaacgccatcagtctgccggcccagtcggcggggaatctggttgctggcgttaccatcgtccagctcacgcagtaaggaggcgtcatgagccagatcagcaagacccattcgcgcctcgcaggccgcaatgcgaaacctttcgacctgaaaaacatcaccaatgacgccgtggcgtctctgcgccgcatcggcctggtattcgatcacgccgtcgtccaggaccagatcaaggccttggcgaaggccggcgcgttccgctccggctcggccatggacagcaacttcaccgccccggtgaccacgccgtccatcccgactcccatccagttcctgcagacctggttgccgggcttcgtgaaggtcatgaccgctgcacggaagatcgacgaaatcatcggcatcgataccgttggctcctgggaagatcaagaaatcgtccagggcatcgtggagccggccggcactgcggtggaatacggcgaccacaccaacatcccgctgaccagctggaacgccaacttcgaacgtcgcaccatcgttcgtggcgagctgggtatgatggtgggcaccctggaagagggtcgtgcctcggccatccggctgaacagcgccgaaaccaaacgccaacaggcggccatcggtctggaaatcttccgcaacgccatcggcttttatggctggcagagcggcctgggcaaccgcacctatggtttcctgaacgatcccaacctgccgccgttccagaccccgccgagccagggttggtccactgccgactgggcaggcatcatcggcgatatccgcgaggccgttcgccagctgcgtattcagagtcaagatcagatcgatccgaaggcggaaaagatcaccctggccctggccaccagcaaggtggactacctgtcggtcaccacgccatacggcatttcggtttctgactggatcgaacagacctatccgaaaatgcggatcgtgtctgctccggaactgtcaggcgtccagatgaaagcccaagagccggaagatgctctggtgctcttcgtcgaagacgtgaacgcggccgtcgatggaagcaccgatggcggcagcgtgttcagccagctggtacagagcaagttcatcaccctgggtgtcgaaaagcgggcgaagtcgtatgtggaagacttctccaacggcaccgctggtgcgctgtgtaagcgtccgtgggccgtggtgcgctacctcggcatctaaccgatgcctattcaccaaaggccgggtttccggcctttgttcactctgactctgactcggttgtaggggccggttagggcataattactaggactacgccaatgactgtttacatcgtttccgccatgactcaatccgtgtcttacaatgcgtatgacacctctgatccgtccaatcctcgccttcagcggaagattctgattcgtggccgcgccggcatcgcatcagaaacttccggcttcggcgacatgatttccgacgcggccgggcgtccgatctggaccccgcagggcgattgtactgccgtgagcgattcggatttcgagctgctccaggccaacaagattttcatgcgtcacatggataagggttatctgcgagtcgtgaagaccgacatcaccagtgaccaccagcggatttccaaagagactcgcaccatggagcgcgatggattccagcctctggacgctgctcgtctgcagcagaaaatcaaggtgactaccgccagcgcttcccaggaacaagagttccggatttaaccgagggtttcggtatggtgattttcgacgaacataagtttcgcacgctgtttccggagtttgctgatccagccgcttatccggacgtgcgcctgcagatgtacttcgacattgcgtgcgaattcatttctgatcgcgattcgccataccggattctcaatggtaaagccctggaagcctgtctgtatcttctgaccgcccacctcctgtcgctgtccacgatgcaagttcagggcgcggctggaggtggcgtcactgccggtgggacccagggcggtttcatcaccagcgctactgtcggcgaggtcagcgtggccaagctcgcgcccccggccaagaatggttggcagtggtggctttccgggacgccttatggtcaagagttgtgggcgctcctcagcgtcaaagcggtgggcggattctacatcggcggtcttccagagcgccgaggcttccggaaggttggagggacgttctggtgatccctggtgcgaatcttctgcgaatggccttcggggtcatcggtactcaaattgtgaaatatcgcaagtttgagcagcgagtgaagaatgatcaagctcagtacgtttccatgttcgaggagcctttcgacctggcagcgtctgttcagcgagtccgacgcgatcagtatgtccagtttaatctggagttccaacggaattacgttatgatcttcgccaactttgagatggttgacttggatcgcgatgtggccggtgaccagttcctctggaccggaagagtctttcagctggagtctcaaggctcctggttttatcaggacggctggggagtttgcctggccgtggatatcggtgcgaccaagctcgctgatgacgggaaaccgactttctaggtgatgtatgtttgacggcgaactgatagcgaaactggttgtcgagttgaatgcggcgatggcatctgctcaagaggctttgcagttcccggattttgaagtcgtccagaaagctcagccgacccaacagggaacgtcaaccaggccgaccatctttttccagaaactgtttgacattcctcgcggctggcctgccaccgattggcacctggacaacacggcccgcaaatatgtagaaataactcgacagcatgtagagacgactttccagatcagttcccttcattggcagaatcctgaaataactcacgtggttacggcttctgatatcgccaactatgtgagggcttatttccaagctcgatccacgattgagcgcgtaaaggaactggacttcctcattcttcgcgtgtctcaaatttccaacgaagcattcgagaacgacaatcaccagttcgaattccacccaagttttgacatggttgtaacttacaaccaatatattcgcctgtacgaaaacgcagcatattcggccgatggggtattaataggcatatgagtctgaggcgcgattcagagctaatcgccgcgcacctccagatgttaagagccatgcgcggcaggtccgtttcagccggatggtattccacggctcgatatcctgacaaggcaggtggatcggtcggaatacaagtcgcgagaatcgcacgtctcaatgagtacggcggaactatcgaccatccgggcgggaccaggtatattagggacgccattgttcggggtcggtttgttggcgttcggttcgtcagaaacgactttccgggagaaaccgaggtaactaagcctcacagaattaccatcccggctagaccgtttatgcgatatgcttggaacttgttttccgcagatcgcgccgcaatccagaaccggatagccatgaggctggccagaggacagatcactccagatcaagctcttgcccagatcggcctggcgttggaaggatacatagccagaagcatcaggaccgggccatgggtggctaactcagcatctacggtcaggagaaagggattcaacagaccgctggtcgatacggcgcacatgcttcaatcgattagcagcagagtaacataaccaggagatcatccagtgatcagtcagagccgttatatccggatcatttcgggcgtaggcgcaggcgctccggtcgcaggccgaaagctgattctgcgcgtcatgactaccaacaacgtcatcccgcccggaatcgtcatcgagttcgacaacgccaacgcagtcatgtcatacttcggcgcgcagtcggaagagtatcagcgggctgcggcttatttcaaattcatcagtaaaagcgtgaattcgccgtccagcatcagcttcgctcgctgggtaaacaccgccatcgcgccgatggttgttggtgacaatctgccgaagaccatcgccgatttcgccggcttctcagcaggggttctgaccatcatggtcggcgcggccgaacagaacatcaccgccatcgatacgtccgcagcgacttctatggacaacgtggcgtcgatcatccagaccgaaatccgcaagaacgccgacccgcagctggcccaggctaccgttacctggaatcagaacaccaaccagttcaccttggtcggcgccaccatcggcaccggcgtcctggctgtggcgaaatctgccgatccccaggacatgtccactgccctcggctggtccacctccaacgtcgtcaacgtcgccggccaggctgccgatcttcccgacgcggccgttgccaagagcaccaatgtcagcaacaacttcggttcgttcctgttcgccggtgcgccgctcgacaatgaccagatcaaggccgtgtcggcctggaacgcggctcagaacaaccagttcatctacacggtcgctacttccctggcgaacctcggcactcttttcaccttggtgaatggcaacgccgggaccgccctgaacgtgctgtcggcgactgctgccaacgacttcgtggagcagtgccccagcgagattctggctgccaccaactacgatgagccgggcgcttcgcaaaactacatgtactaccaattccctggccgcaacatcactgtttccgacgataccgttgcgaacaccgtcgacaagagccggggcaactacatcggcgtcacccaggccaatggccagcaactcgcgttctaccagcgcggcattctgtgcggcggtccgaccgatgcggtggacatgaacgtctatgccaacgaaatctggctgaagtcggctatcgctcaagcgctcctggacctgttcctgaacgtcaatgcggtcccggcgagcagcactggcgaggcgatgaccctggcggtgctgcagccggttctggacaaggcgacagccaacggcacgttcacctacggcaaggaaatcagcgccgtccagcagcagtacatcacccaagtcaccggtgatcgccgcgcctggcgtcaagtccaaaccctgggttactggatcaacatcaccttctccagctataccaacagcaacactggcttgaccgagtggaaggccaactacacgctgatctattcgaagggcgatgccatccgcttcgtcgaaggatcggacgtgatgatctaatggtttgcggcggactcgatccgccgctaccttccataaatggagtgaggaataagcaatgatcaacatttctgcgttcggctcgatctgccagttcacggcaagcagaactttcccgaacggattcaccgtcaccgagttcgccgacgatgccgatcccatcgacagcccgccgttcaccgctgccgataccggcgtcggtctcaacggtgacatggtagtttggaaccgggcgaacatcctggaagtagtcgtcaacgttatcccgaacaccgagggcgagcgcaacctggcagtcctgctggatgccaaccgcaccgggaaagacaagtcgggcgctcgtgatgtcgtcggtttggtcgtggcgatgccggacggcagcaaaatcacctgcaccaacggcacccccatcgacggcgttctgatcaacgctgtggcaagcgtcggccgtctgaagaccaagccgtatcggttccgattcgaaaaagtgatcaaagccggtactagctgatgaagaaaattccgctgacagcagtccccaatcaagcgatctcatttaacgccggtagcagctattggaagattcgcctgtaccagaacatggacatgatgaatgccgatatcagccgcgacggcgtgatcgtttgccatggggtccgctgcttcggcgggattcctcttctccaatacagccatcagtaccgacctgactatggcaatttcgtcttcgaccgcgacgccgattggacgttgttcggcgacggaattaacctgttctatctggacggcgccgaattcgcagagtatcaggcgctcgccacgaggaaagaatgagcacatcaacgatcagaaccgggacgaacaatgatatccttttggacgacaatggaaacatggtcatcctcagggatgtcgaagcgtgcgcccaggacgttcgggcggcgatgctcatgcgcaccggcgaaaatattttcgatgtgaactccggcgtgggatatttcgaatacatcttctcgccgcagaaaagctatgatgacgctcgcaaatccatcgcggatgcaattttgtcctcgccggatgtgaccggcatcgagcagctggacatcgacatcaccggggaagtcttcggcgtcgatgctaaagtcatcaccatccacgggcctgttaccacaggagtttgaaatgagcacaatccgcatccaatacgccaacggcacccaactgttcctggacggcaaaaatccgccgcccctggacctgctgccctcgtttaacccgtctgtcgaagatctggaaggcctggaccgcgaaaagaacaccgacaaaggcgactcctcgccggccggtcttcccgttcccccggtaaacgtcgattccaatgtcgacaacggcggaaccatcccggctccggtatcgaccgacgctcctgcggccgaatcggccccggaaggcgcccaggaagctcctgcagcgggccaaggcgacgagaaaggcgccgaggaagccccgactaccgccccagtagaaaaggccgaggaaacggcctcgccggccgctgaagaggcagccccggctcccgccaaggccacctctcgcaaaaccaccagcaagtaaggactcgacatgatcaacgtcagcggcttcggcacaggaattgtaatagtttccgcctcatcgttcccgatggggttttccttgtcgaagttcgctgatgatgagagtccgatatcctccaaagagctggagccgttcggatatgagatgctttatgacggtggcctattcgcctttgacaaggctgctcctctggaagtatctgtatccgtcatcgcagggagcgaggatgatattaaccttcgcatccttctcaattccaaaaagggatcattcagatttcttccgggaatcatcccggacatgacgactctcgtggccactcttcctgatggcggccgcaccgttctgtccaatgggactatcatcaagggtccggccatcgacaccatacagaacaccggacgacgcaaaggcaacacgtacacttttgttttcggtagctatcttggcgcccagactgcgcgtcaagccatttctaacgttatccaatcggtactggaggtggtctgatgttagggattttcaccagcctcctaagttcgcgatctttttcgattgtggaccaaaacacaaaccagctagttgctgcggatttgaggataagccgggtcaacacccggttttcttctgtagggcaacgccacatgctggaagatggtacgaccaagatggattccagaacgatccaccctatggaaatcatcgtcgaagtattttgcccttcaattgatgtcgtcgatcagatcaatcaattgctcctggatcgcgacacactgtacaaagtcatcactcgcggcatggtattcgaacggatgatgtgtaccagcgaagcgctcaatcagactccggatatgatatcggcgactcctgcgcggctgacattctcccaagttctcgtccagaatcccaagcctataatgttcagaaatgcaggggactcttctatgatcgaccgagggctggccctagctgaagacgtggttggctcggccggcgatctgttcgactacgcagtgaacggcgtccagaacgccgcagacttgttctgaggtgccaattgaactctttcctcaagtctattctcaacacgcctactctcaccatacgcgatgatgttaccaaacttcctgtctggaagagtcttcaagtcaagaaagtggaaatttactcgccggcttccgtagtgtcgaaacctctggcgacgaaagaccagacggaagctcaagtgtacaccgaagctctggacattgatgtgaagaatggaaagatcatccaaccggtgcgactccgcatcagtgctatctgtccggacctgtccaccgttgaaagtatcatgaacgctttcaatgataacacctcgactttcgctatcacttctaagtcgatattggccgataaaatggccatcatgacgctcgatgtagatcagtctccagacatgttgaacgcggctgagatcaatatggaattcgagcaggttgagcctccagtattgaataaattcgatcctgcgttccctcaagatagtccgacttatggggtacagattcaatctctttctgatgctaatttgctggatttgggcgccatcggcgattcgatatcttcggccgcaaaatcgctatataatcgcgtgaccagctacttctgagggtgtatcatgcttgaaatcaatcttcccgatggccgtcaaactcgcgtacaaatcgaggcgtggtcggcattggatggctggggcctccagcgccgtttcgtcgaatttgctgtcagccaagattccgacttccgccgctctttcaccatggaaatcctgggatatgcgaaagtgctgcttggcgacgatgacaccggcattccgctgaccaccgcggcagtcatcaacaaccacctcggccactggaagaacgtggaactggttttcaactctgttctcaagcacaatggcatcgacccggccacgcacgccgaccggccggactattgggaacaagtcggatcgcagatggccatcgcatttctggccgaggcgtccaagctcattggtccagcaatgaagatcgccgaaggactcgccaacaagccggagtgattcatgtctagtgatttggatgaattcatacttcggtatgaggccgatactgccagagccgagcgcaatctggagcgcctccagaaccagatcaggcgcgtgaacagcgcatcgacgagtggccttcaggatttgcgccacttcgcagacggcgcggccactgaactcggccgagtcgttccgcagatcgattctgtgacgagcgcgattcgcgggatgaacgcgcaactggcgataggcgccactggcgtggccctggtcgcggccggcgtcaaggcgttcatgaacaccagggaccagtacaatcagcagcgcatccaggcgatggacatcggcatcgccccggcacgcttggaagagtaccagagaaaattcgttcgccagtccggtggaaccatcagccgcgagcagggcgcggagatgaccaaaaatctggcagacactttccggcgtgcttatcgcgatatcgggcgagtcggcccggaagcgcgaattctgcgtatggccggcgttgatgtcgggagcttccaaaagggcatgcggccgctcaacgacatcattactgatctggccacgaaaatggccaagctgaagccggacgaaatttctgcctacgctgatgcccttggcgtctcgcgagactacctgagcaccctggctaagatcggcccggccatgggaaaagtcaccgagatgacgactgcggaactccagtccagggtccagggcgagtccaacattcagaaattcaacgatgctctggcgaatctcaaccagacgttcaccaccctggaaaaccgagtcggcgaaaagctcgcgcctgcgttcaccaagctgatcgaaatcatcgacaagatagtccaggctattcccaatgaagtggaaagcttcgcgaaggacaccaaatcccgttgggaagatggagtgctcgggaaggcgaccgttggcagtgatatcctatccctcctcagccccggcgccctgctcggtcgcctggcagcgtgggggactcgtcgcggcatggaagaatcagggctcatcgacaaggacaaggttcccggcgctcaaaccagcgaagacctggccaagaaacaagaagaccaggacaaggctactaagtccatgaaagagctagagaagctggctgaccagaccacgaagtctaccaatgattttgcggtggcgatcaacatgttcagtggcgcggtatcgtcgttcgcgaatgccgttgacgagcgccaagcttgggcagcctgggcgggggaaattggtcgggcggtcggtatgggaagcaccgcgccgacttcgcgggccaccggcgtctatccgcacgcgatctatgatcagtcgaagagtggcgcggccggacaagtcttcggcgagccaatcggcgcccagtctcttcgcaatcgcatgttctcgccgcagcgcaaggccgaaccggtcaccgttccatcgtacatcaacgacatcatcaaagatgcgtcgaagatgtacaacattcctgagctggacatcaagaaactcatatacaccgaaagccgattcaacgccagggctaccagcgaagccggagcgaaaggcctcatgcagctgatgccggaaatcgccaaggcgtatggtataactgacgtatatgaccctcgccagaacatcctcggcggaacgcgtctattgcgggaaaacctggatcgagccaatggcgacatgcggctggccttgacctactatcacggcggcctcgatccgaagaactggggaccaaggactcgcgcatatccgggtttggtgatgagcgctccaatcgagctgatggaagaggcgcagcgcaagcagaaggctgcggccatgaccgccgccaacgagacgttcgctccggaaggcggcgacatggacattcgcccctatgatggcggacgattggaaactccagaccagggcaagaaggaagatgagcgccgcgaagcccgtcgatatgacgacagggttgtgcgaccggaaattcgcatcatcgaccgcatgccagaccgcagcgacggcgaaatcctcaagatgtctagacgtcaagaggccgaccgggcagattctggattccggaagttcccgaatcaagttcgcggcgagaccaagcagaacatccaggctcaactcactgcaggagccatcgcgcaagtgatcggcgttaaccccaaccagatcatgcgccgcgaaatcagccgttctgacttgctgttcggatacaaccaagccatcctgggcaagcaacaggagatcaaggccgccgcgaccgaagccaacaacgtattcctgtctccagccaagcttgccgaagccacggccaaggtgaacgccgcatcgcgagaaatggatattctcaggacatacggcgagcaacttctgaagagcgctccagagcgcggccaggagctgaccatcggtcgaatcgacatgttggtcaacgtcaccggcgcgaattctccggaagaggctcgcgagatattcagtaagcagactgcagaccagctgactacggcaatccaggacgctcaaaacgattccgcaactaagatactctactgatgaaaaagagaattctgcgagtaacattcaacatgccttatggacccgaagtcatccgcgaagatctggatgttcgggtccggattatgaaggctgcgttgcggattcagaaccgggcgacgatggaaattttcggcctcaccactcagctgcgcgagtctcttctgtcgcagttcaccgcgtggaagcaccggcaacgtcaagtgggcagggaagatgaattgatgatcaaggtgtcggtggaagccggctactctgaccaggggcgcgagcaagtttccagagtctttgtcggcgaagttgccattgtcgatatcatttctccgccaccggacattggaatccgcatccagtgctataccaggcaaatcgacaggacgaagaccattcggaatatgccgcccgccaacacgacgtttgtcaagttcgtcgagtggggcgcgaacgaaatgggattgaacttcatctgcgataccagttacaacgatcaagttctgaagaatccgggccggtctatcactgtcgcgtcggcaatcctggcgtcgattcaggatatgtacatgccggacgtggccgcgttcgtcgatgatgacatattgatcgtgaaggaccgcgataaagtcattcgtccggatgaggtgaccaacgtcaactcgtttgttggaattccatcttggtctgaatggggcgtggaattccagtgtctgtttgagccatcgattcgtgtggctggaggcgtagcggtcgaatctctcatgaatccaagtgttaatggtaactatgtaataactgctctggaatacgatttggccagtcgggatcggccgttctatatcaaagtcatggggagtccagcagcataatggccagggaaatcaaatcattcaacatgttcggagttcactatacttcgcggcaattctctgccgtcgatgggctcagcatgatgtcggaaattcagagcgtgccgccagaagaattgctcaagggtactgatgtattggcgcatccggaagaccatccggaaggcatctggcttccattgactgctgcgaacatcaatctttatgtcgttgatcgagcgaaagtaatagctcccgtacaagttcttgcacttctgtccgaagtggtaatcgactggaattttggttttctcaaagactggaccggagtcaagattccatccagatttgtcgaagatatcaaaagcgtgaagacggcacattcaccttctgtagttgcgagtttggtggcgaacggttcggcctctatgcgcgagttggaagagtattattcgactcaagatgcctttaagatgatagatatcatgacggcgaagagcgtgaacgaggccttggcgtccgaagcatcgcacaacagaatcaaaaagggataattcctaaccgggcctgggaaggctatactagacctgccaaatcagaggctttcccatgtccaatatttctctaacatcagcaaaagctcccgacaggacgcgactgatcgccgctcttgacgctcggtcgcggcgggatgctctagatttcgaagtaatgataccggctcaggttgttcaatatgacagggccgagaatatcgcaacgattcaacctctcatcacctgggttgacacggaacacaacgccgtccaaaggcatcagctggttgatattcctgtaatttccatgggggctggcggcttccacataagtttcccgattcagcaaggtgacataggctggatttatgcggccgaccgcgacacatctcagttcctggagtcgttgtcaatgtcgaagccgaacaccggccgcatccataagttcgagcatggcctgttcatcccggacgtattccgtcgatacaccatcaattccgaagattcggccgctatggtcatacaatcgacttccggagcgaccagaatttcgattcgcggcgacaacatcaagatcactgcgccgtcgaatgtcaccgtggatactccgcaggcgaatttcactggtgatgtgactatcgctaacactctggttgtaaacggtatcaacgtgaacaaccacggccacctcgaaaacaacccgcctgatgcccggacgaagggcggcatgattgcttaaggagaatttcatggcaagttttgatttttctgatttaacagcgggggggggttgtaatggctaactacaactacatcgtcgatactggtgtgatagtcgcagataccgccgacgttctgagtgacgttgaagccgagttccgcgccgccctcggtgccaatatcaacttggccgcgagcactccgcagggatcgcttgtcgcggccgaggccatcgcccgttccagtgtcatgcggaatgaagcgcgaattgccaatgccataaacccgaacgtttcattcggaacgttcctggacgcgatctgtgccttgatggggatcgagcgcggttctgacctgtcaaccttcggctatggagttcaagtcaccggccgcagccaaacccgcatttccaccgggtctagggtccagactccggccggcgcgatcttcacagtgatgagtgatgtcacgattcctgctggtggtgtcgcgaccatcgatatcaaatcgcaggagtatggcaacattcctctgccggtcgggaatctcatcatcatcgacggaacaattggctggtccggagcgaaagtcatcgcctccactcgcgtcgatccgggcagccgccaaatgagcgatgcagagttgaagaatgcccgcgttaatcgattggccatccaaggccgcaactcgactatggccatcaaggcgtatgtgagcgccgttccaaacgtcacgtcggtgaacgtaatcgagaacaacaccggcgccgttcaagtggtgaatggagtctcgtttacccttccgtatgctgtttgggtctgcgtcgccggaaacccggataaacaagcagtcgccgatgcgttgtgggccgcccataacggcggaactccatgggactatggtgcgacgaacaacggcgtcccggtggacggtccgaatggcgttcctgtgcgcgatccggcgtccggtcgaaagtatgtcgtgaagtggaccactccaattatgtacgatggatatgttaacgtaacagtccagcaaggttcctcctctgtagctccggaagccattcagaacgcagtggtcaattacgcccaggggaaagtggaaggggaagaggggctggtggtgggcgcgagcctgtcggcattcgaagtcgccggcgccatcgctcgcgaaattcccggcatctacatcaaactctgccaggtcgcgtgcgtcgcggctggctcgccggctccggctccgggcgatttcacttcggaatacgtcatgagcgcattcggccaggctaccatttccgttggtaacgttcgggtgactttcgtatgactctgcctgcgtacaattcggacatccaacaagctctgaaatggctccataaccaggcgcctgggatcaccggcctgatccagagaaaggcgcaatggtatgacagattcagccgccaattctgggccaactgggagcgcgacgttttccacttgaaaaccgccaacccgttcggccttatggtttggtgcatcatcctcggcacgccttcgaaagggttcggcctttatccaaaaaacagttcttgggcattcggtcggctacgccagaacttcatctatagcggtacacaagttccgccaccggcagacgcatcgcctggcggcaacttctacggtggcggcaatgccgaaattctcaacttggacgaaatcaggaaagtgcttcagctaagatatgtagcgctgatttctaacggctcgattgcatatgtcaatcgcatgcttcgttacatattcaatgatgatgagccatgggacgaggcgaccggtctgtacttctatctcatggactcaaccggcgagaatggccctgtggagaacttggcgatatatcggaaagattgggaaggtatggtgctattgtccagttcgcccagaacgaaccacgtgctgacatcgacccctgccagcgacgccgattggccgggagtcgatccggccgcgagcggtattccggtaacggtcgaaacggcgtccgctacggccccggacggctccgctacggtgtgcaagcttactaagccggccgggagtaccgcttacgtctccgcgccgatagatgggccgctggggtccggtagcactgtcacgttctcgttcttcgcgaaagccggctccacccgtttcattgcaattcagtcggctgccgatttccccagtcgagccgatgccgttttcgacctggattccgggaacgtaatcagcgatcagatgctggacagcagcgtggtaagcgcccgaatgattcgtctggaaaatggctggtggcgttgcgttctcacgaccaagaccgtcagttcttcgttccgcgctgcttacgtcgctccggcagaaaccaacttcagctggattgattcgagttccagcgcggcgattgatgtgcttatctggggcactcagatcgaactgggtgatactccaaccggatacttggagactaccggaacgcccgtaaccatcaccgattacgttctgcagagcgcccagaccggaacggtcaagttcacacagcctcttccgaccggagtagaagcgtattggactggagactggaaaggtgggtctgcgaccgagccggccagattcgcagtaggggatgggactcaagatacattcaatctgtccagccctgcatacatcggcctacccactagtggggcgttcaagctagaatacagagttggtccggcgcttaatttgtcgccgcaattgatcaacctcatgaatgaccgggcggtcggcatcatgccgacttgcgccggttgcgatgtaaaagtcattcaggagtaatgacgtgatcacacccgaactgatacccagtccgtttgccgctcagggcgataaagacccgattccacaaacctcctccactggcttcgcaaaccttcgcgacggctatacgccggactacgaaatcagcctggcgtcgaacaacccgcaggccaaagcggtcgagcggaaaattcaaaaccaactcttcttcatcgcgacccagaacgcacaggcgtggcagcgacaaatggcgccgccgtggtttcagggcatgcctggcggctacgaacagaatgcagaagtcgtgcgcgtcggaaatgacggcataatgcggcgttatcgttccatggtgaatgccaatgcgagcgaccctctcagcagcacgacttgggaagaacaacccgcatggtcggtgatgcgctccaacatcccgatgccggccggaggcccaggcctatcttctggcggagaagtcatcacgaccggccgcaacttcaacgacctgttaaatgggacgtgggagttcttctctgattcagtggttatcgcttctcagaatgcccccgtatatccggcttccgctggtgccgctgctggcatgttggaggcgaaatcttgggtgtccggagccaatacgttctgcgtccaacgctacactgatcgcgtcgggaacgtcgctgtgcgcgggcttaatgccggagcgtggaccaactggatgtatgcggtaaacgtcatggcccttcaacaaggtcgggtcacctatggagtcgcggccggatcggcgaacgcttacacgttgacgctagttccgcagctccaaggcggcctggtggatggcatgattcttcgggtcaagttcaacaccatgaacaccggcgcctccaccatcaacgtctccggactcggcgccaaagccatcgtcggcgcggccaacttccctctcaccggcggcgaacttggccaaggactcatcgctgagcttgtcttcgacgcagcaggcgaccgctggagaatcctcgcaggcgcgccacgcatccaagttggcaacgccgatcaagattaccaggcccccagctggaaacaggtgaaggattacgtcgcgtcccaaaagctgactgaagtggactgggctgacgtcgtcaacaagccgaacgtcgctatccaagacactacgccgtggttcgccaatctggagttgtctgacgctcggcctttcatcgatttccacttcaacaacaaccgcgccaaagacttcgactatcgctttatctctgaagctgatgggtcgatggcgttctactctcgccaggggtccgctggtcctacccaggatatcctgttcagcaggtcgaatgttacattcctccagccgcgactggatgttgcgaaaaacctcgcgtacatcgcgaactctggtcccctttggcagaacaccactgccgatcagcctggttggaaattcaccttcgcacaaggtgtggacgccaacaacaacgcggttatcgcagtcaataccaccaaccctgacggctcttatcgctcgcaggtcatgcgatgggactgggcgtccacgaacgtcatattcaacaaccgtccgctcttcgccggtcaatacaccccttgggattctgggaacttcgatccttccaccaagttgacggtgagtgccacgaaccaaatcgccggcccaaccgggattcggaataccaacggcaacaccggcaacatgaacacctggggttccggctccacgacggcatcctatggcaatgctgccattcaaatcttcggaaaagggggcggtgagcctgccgcgatctatttcgacaactcccagaccggatggtatctgggcatggacaaggatggacagctcaagcgggccggctggtcgctcggcaataactcctatgtgatcaccgacgaatccaacatccgaacccatatcaacacaatggctgcgcgcccgatttgggggaatgtcgagttctggggtccgtggaacttcgatccgaatcttaaactcactttgaacgctttcaatgatagctcatacaccaggatgaccaacagcggcgcgaaagacgttggtatcgcgtccatgacgagttatgctgatgcggccatgtcattcttcaactatgaagcctcgaatccgaccgggccgcgcgcggccgttatttcgttcgtgagaaatggatcgcgtggagtgctattcggcttggattctgacaacaagctgaagtggggcggatattccctaggggccgtcgcgttcgagattgccgactccaacaacctcatgagcctgtggtcatcccacgctgccgcgccgaactggaacgggcagaccatctggaggtcgggaaacttcaacccagacaccaaggcgactttggcagctcgcaatacgacgtcatcccctacaatattcagttatggggcgtccggaatcgcatcaaccggacaggtcggtgcgttggttgtggaaaacaacagagtcaccaataccgcagccgccatcacgttccattcgccgcagaaatatcaggtcaacttcggcctggatgcggacaacgtggtaaagatcggtggcggcacaatgggcggcgtagcatatcccatcatccactccggcaactacaacaactacatcaaccaggcgctggttcaggtgggtcttggcggagtcggttcctacgcgatccttgccgtatttgacacctccgcgccggcagcgtccattgcccccggaacgatcatggacagttccaagctgttctattcgtcctgcgattcgacctatcgcagcagcgcccgtccgacgggcacctggcgctgcatggggtatgtgtataaccgagactccaccaacggcgactcggcatccctattccagcgggtaacgtaacatgaaatggacgcggatcagaaaccctcgttggctggatgaaacaaacatccacgccatggtgactttcgatgggatcggggaagttcctttcaccgccaatccgcacgacgtggaggcccacggaagggccatccacgctgcgatcctatccggggcgcacggatctatcgccccggtcgatgcgaagcgggagcaggccttgcaggacgctatacgggccagggaaaagcgggctatccttcgtgatacccgctggcccatagatcgtcacgacgagcagaggcggctgggtatcgaaaccacggacggacctgggttgatagcagcccttgttcactggaggcagcagattcgcgattggaatagcggggatcggccgcgacttcccatggctctgaaaacgatgttcaaaaatcaggagtattgatgaaaatcacgaaggatgttctgatcaccgggaccgggtgcaccacggatcgggcgatcaagtggctggatgatgtacaggcggccatggacaagttccacatcgagtcaccgcgagccatcgcggcctacctcgccaacatcggcgtcgagtccggcggactggtaagtctggtggagaatctcaactacagcgcccaagggttggccaacacctggccgcgccggtacgcagtagacccgcgagtccgcccgtatgtcccgaatgctctggcgaaccgcctggcccgtaacccggttgccatcgccaacaacgtgtacgcggatcgtatgggcaatggctgtgagcaggatggtgacggttggaagtatcgcgggcgcggcctgatccagctgaccgggaagtcgaactattcactgttcgccgaagactccggcatggacgttctggagaaaccggagcttctggaaactccggccggcgcgtcgatgtcttcggcctggttcttctggcgcaatcgctgtatccccatggcggagtccaacaacttctccctggtcgtgaaaaccatcaacggcgccgcgcctaacgatgcgaaccacggccagctccggatcaaccgctatatgaagaccatcgccgcgatcaatcaaggctcctgacattccacccaaagaaaaggccgcttattcagcggcctttttgctttctggctttgcctcttcaaccatcttgatctcgaccggcgcggcggactcctcctgagttaccgaatccacatagttccctagtgaactcagaacgccgattaacagcgctcttactaccttgtccttgactgtctcgcctatgatcttggtcagaacggatatcaactcttcccggagtcttgggctgattcttggccgaaagcgcttgcgatgctctttgcgtttcatgtttagtcctctgtctgcggtcttctcctcaccccgataatggcttggggatgcgctgtgttagtcggaagggtcgggcgctattataacccgtcgaaaatgctcgcgcttaactgtttaacgatacgcaccgcgatactaaatcgccttctttctggccaaggaactctggcggcctggtccggtctaaggcctaatttgtcgacattaaaacgagaaaacccggatcgcctgtaggacaaggcgtccgggtttatttcgatctagtgtacgctagaatcagtggcttccgccccaaccgtccagccagcaatcgaagacggcgtgtctcggcttgtccttggcgccatgggagaagtgcttgaaccggatgacctggcccttgagatactccctgtcattccagcggcgctgtttctcgtcgtgggtcaggctggaggccgacacgttgaaggtgactccaggccacagacgttcgttgcggcagacgaacgcaccgaccattccggacggcgacaggttttctgcgtggctggagcgggccgtgtggccaagttcattgatgaaagcttcattgttgttgtgcatcaactcttccacgtcgatgatctcagcttcatcgtagtcgtatcgcttgactttcacacagtgcccttccttggcagtcgagcgaccgaacttgtacagtccatcagcgcgcttgcccatggacccttcgaatcccagcatcgtgtggcggcgctcgacttcgctgaactgttcgatggaagtcaccagttcctgctctaccaggtgaatcctctcatagccgaggcagttacgcaggaagttcacgcgctcggccgccctggctaggcgatcttcggtcggtgcgcgaggatcggtgaaatcatcgaacacatggaaagaccagtccggctcaccgctgtggcggcgaagatcgccggacgacttctggaaaactttcgggtcgctgatgtcgccgcagaccagctcgccgtccaggccgttgaacagtttatcgctgaggtattcgtagatcgattgattgttctgccgcttgagttgacgagtcagcgcctcgccttcgaatacgaagcagcgaaatccatcgatcttcggtgagaaatacatcggcagttggccttcaagcagcttcgggtcaaaattcgatgcgagcatgggtttcatacagttctccagaaaagaagcccggcgaaccgggctaaatggcggtaagccggctcagatggtttcgttggcgtggttcagttcggccacgatcgacgcatagcgctcgtccgactccttgatgaacacgccgtcgtacatgacgcctttgcgatccttgatggtgtcgtaggccgcagcgtagcaggcgagcatggtagtgtcgtgctcttccgtcacatcgaacagagtcatgacggccaagaccaggctcttgatggctaatccatgatttccgcgtgccagcgcgccggccagatgtccgaggtgctgcaaatcgtcgccgtaggtgggatgaacttcgacagtctcgctgaagaccgatagatgatcgaacagattttcaccgagttgcgcggccatgaccgtggcaaccaccattacgtcgccgatgccgtctttcacctcgactggtttgttataaacccaggcttcgcaaacttctgcgaactcttcgaccaacttcaggaattgatccttggccgaagagcctttgatcaggttccggtcggaaccccatttaacaaccaggtcgtgaagttcgcgactcatgatttgttcgatattcattctttcgattccttttggatttgggatttgactgcgttgattatggacgccgtgctctggcgcgatccatccttggtggtgccgaagtagaaggccatgaccgacttcagctcggcgaaccaatagccgatgatggtgccgatggcgacagaggatgtcgggtccatcagagcctcgcggccgaaggtgaagattgcgatgatgatgagaatggagcccgtcagaagagcgaatgtaatcgccgggcgaacgaaatcgttctgctgcgcggcaagcctcctcgccgaatccctgtctgccgcctctgcggcgaactggctaagctcggcctggagctgattctgctcagactgaaggcgattttgttcggcttgaatcgcaagctcctggagacgaacgcgctcggcgctctggagttcggcgaggcgcgctagagcttccggattcgcgtctagagcgctagcgaccgaggctgggtcggccttcgaccccagcgccgtcgcgacgatagcgccaacggcggcgcctgcaggcccacccaggagcgaccccagagccggggcagccgcgccgatcttactacctatgtctttccagtccatttcgactcctcaaaagaaaggcgccattacagcgcctttctctggccgttgacgttagaactcttcggcttcggtcgcatcgccgacgccaccggcgtcactgcgaggctgttcctgcttgctgtagtccaccttcacctcgccgccgacgaacgacttgtacaggtcggccgcagccttgaagtgatccgggttcttcaccaggccttccagctcgaactggacgccggaccagctgcccttgtcgttcgacatgcctacggtggtcatacggaccaggttggcgaaagtcggcggggtgcgcaggccctgcggggtctgaacctttttctgggacagcgcggtcatgagcttcttcgaggccttgatctgcgaagacgacagggagatcagagcctggccgaaatcgccggtgtccggatcgatgacgatgacgtaatgaccacgggtgtcggcgaagtagtcagacttcttgtcgctgaccgaaccgtcttcgttcggcgcgtacaggcgtccttcgacttccttcaccttggtcgggtctttcatcatttccttgaagtcttcgacgctgatggcgcccttgaaaccgccctcggcctcgcgaccggcccagcggatgaactcgcggcggtacgcggccggaatgatcagcaggccggtcttgccgtcgtaaaccttgccggtgacggtgttcaggaacatgccggccttcgcgccttcgatgtacttcgggtcatcttcatcgacctggggagacatcttctgcaaaacctggatgaaggggatggcataggactcggcatcggcgccttcgaagcctgcgccgtcatacgatcccaaatccatgaagtcgggaacttcggtagtcgcgacggcgccgccaccggtggcaactgctacggccttggtttcttcggttgcttcggaagtttcggttttcttaccagccatgttaggctccttgtttgtcgaatttcagttatcgctaactgtgggtttataataacggaagttgcaactaagtaaagcaaattacatattaagatttgctctttttcaccttcggtttcgtgatcttggcctctttgtattcgtgtacgccgatgaaatctggcagctcttcgcccttctccaggtactcgcgaccgaacgcctggagggtctggtaatggacatcgcggttgatggtggcgtcatagccggcttcgatgatggcctcggccgccttcttcgcatcttccatttcgccgcgaccgaattcggccagaaccttggtcttgatgatgccgtcgttgtcggtgtcttccagccacttccagaacttcgatttgttctcttccttgacggaaatgatggccttcggctctacttttaccgtgcgaccgtccgccagagtagtggtcttctgaccaagctcctccaacagctccggaatggtgttacgcttgagggtcttcagctcctcttccttttcggccagcgccttttgaagatcgaggatttcgccgtccagctgcgaagccttgtccaccaagttcagcagtcgatggccgatgtcggtggcttcaaccgccatttcatccatgacgccaaaatagtcgatttcgcccggcgcgttctctttcaagtattccgggatttcaagctcttgctctttcatgtccgcctccaacttattgatgttcccttacttgaaccaagtattgagtagatattatgccgcatcttccttgatacggctactgatttacatattaaatttcgtcgcgagtgctaacgtcagcctcaaacacgccatcaacgacataacttgccaggttgcgtttccactccaagctgacctggattttctcgtcgatggaatccagacagatcaggtcgaagtacagaaccgagttgacggtgccgattcgatgatttcggtcttcggactgcatccgcaactcgttgtcttcgtcggtcgtgtagtaaatggccacgtctgcggcggtgagcgtgatcccgatccctgctgcggccgggttgcccaggaacacctggacgcgcttggcctggaaatcgtcgatcaatttttcccgctcggcctctttggtctcgccgtagtaggtgccaaacgaaatcccttgggcctccaaatacgccttgatctggtcgatttcctgaatgcgcatggcccagacgatgatggaacgctccgggtcttcctccagcagaccctccagaagatcagtaaacacggcgaatcgcgggttgtcttcgggcggcaggatcaccggctcaccatagacgttgatatagccggacgccacttgcttgagcttcgagcgcgctgccgcagcatcgaaagatacatcaagcatgaaatcttcgttctggagaacaaagtggtagtcttcttccacgcgctggtaaacctttcgttgctcaggcgacatttcgaagtatatgcgcttgtacactttgtccggcaggaatgggagtgcttctttcttcgttacacggaaactgtgcggctcgatcagggaccgcagcttgtccaggttccggaataccgggcgcccacactcgtctttttcgaccagttgcggcggcatggtttgcttcccttccagcttgcgcatgatagcgatcattcgaggatcgtcactgggcaccaagacggaaaattcggccacaaacgcccgataggatttagtccccagaattccattccgcaagaattggaactgcatgaacaaatcggtcggtgcccgcgtcagaggagttccggaaaggatgcgacgggccacggccttctcgcccagctttacgatctttttcgcacgcttggcttgtgggtttttgatcctcgttgactcgtccacaattgcgcaaactttgaatgtatcaaggaatcgctcgacctcatcatagccagcctggtggttgattgcgtcaacgttgatggcgaagacgcgaagaactttttcatctgcgaacgtctcggaatacagacggtccaagcgcgccctggcctttttggaagtcggtcggccgcgccaatccacgctcaaagtcttgatcgcgacgtgggtgggaatctcgcgcagaatccagttggtgtggacgcctttgggggcgacgatgagcagcgcgtccacgcgcccctgtaggaagaggcgaacggcatcggccaaagtcgtccaagtcttcccggtgccctgctccatcaggtatgcgaagttccgtttgttcagggacgctgccagggcattgaattggtgctgcatggcctcggtcttcatgcccttgacgggatatgttttggctttcatttgttctccaaatcggcgaggaactgaacaatgttatccagtccttctgcatagctcgcaacttccaccaagtcgcggctgttaagctcgaacaaatcgagcataggattcagcagcagccaatcggttccgatcttggccaggacgaagccccggccaccccagccgatccgctcccgaagaaaagggatttgcccaggttcgaaacatctggccattgggcaggtggaagcgcgtttcggccactcctccaaagccttgaactcgacccagaactggacacctcgacgattcaggcagatcgaatcggacatgccagaccgccgcgtctccagaaagtcgatcaggattcggccgagcgagcgctgcttaaacgcattcgccgctttcgtttcgcgatcattcatcaccttcgccctctttggaaactttctctgcttgcgctgccagctttgctttttcgcgttcggtcaaaatccgcttgacggccttcacgatgaacatatcgattccgctgagcttccagcctttgatgaggaaccaagaacctgtcggcgtcccttcagcaatctgctttccgtattgcagatatttttcaggcctaattctgaaacgtatcggctgatcaaccgagtcatcaacacacatgatgtcgagaaactgcgactggcccttgtacaccgggtttttcccttgatcagccctcttcttctggcgaatcggttcgttctcatcagacagaacttttttcaccatcttgacaatgaccagaccatcatctccatcgcggatatcccgaatgttctgaatggggtttccggaagttactccaaccagctccggattgtcataagcatgaccccagagcgtgtgagcttcgttcaaatctgcgaattgaacttcagaattcgacagactcgcggcgactttctcccaatcctgaagcgtcttcaggtgggtgcctgccagctctttatattgagccttcaactccttcagatcggccttcaactccttcagatcggccttcaacagtttctccagttctttgtcttggctgattttcgccgaaagaatctgggcttccagagctgctacatcagcagccttgtcctcaacatcctgtgccgatatcgggcaattggccagggcgatcctcgcggccttgacttcctcacgaagacgcaggaaccgctcggccttcgccgggccgaagcctttggcgttcatgatgccgccgatcaggcgcccgtccgccaccacccagttgagttcggaatgctccgggtccagggccgtatattctacgccttctttggccaattcgcgaaggatagacacagtttgctggtcgtccttcgccgcccgaaggcacgcggccgcgtattccaggcgatgataccgcttcatgtagcaagtccagtatgtcaccacggcatagcttaccgagtgggagcggttgaatccccaggcgccgaatgtcaccatttcctgccaaactcggtgagcgtcttccggggcgacgcctatggtcttggcgccctcgatgaacaattctcggcgcttgttgaagaactcttcgcccttccgcgccgacatcgctttccggatcgccgacgtttgttcccagtcgaactgaccaatgtccttaacaattgacatgatctgttcttggtacaggaacacgccatacgtccccgacaaatactgctcgacctgcggaatggtataggtcacaggctcgcggccggccacgcgctcgatatacttggttgccataccagaagacaacggacccggacgggcgagcgccgtgatgtggtcgatgttctcgaacgcggtgatgttgatcgcgtttgctaccgagcgaacggcctgcccttcgaactggaagatgccggacattttgtcttcattgagaacgtccagaaccgccttgtcgttcaaaggcaagtcgtacaactcttgcgcggtcacgcagttcgcgtcctggatgactcccaaagttcgaagtccaagcgcgtcaattttgaggagattcagatattccgaatcgggcttgtcgagctgcgcaacgccttcggaagtcaccgtacagaagtcgatgacttcatcgttgcagaccaggatgcctgccgcgtggacgccagagtgggatgggtgaatttcgaggtcgcccatgcaggcggacgcgatctcatacttttcacggaagtcgcggccgggctgagttttttcgaaagtgtcctccaatccttttccatatcgttcgtccgctgatgtatattcgatgatcgagtttttgatgttgtcggtatcgtggaaggggatgccgaagcgctttccgacgtgagcgataaccgacgcggccttgagtgtgttgatgttacccaacttcacaacgttccaagtgccatacttctgctggagatattcgaacactagatagcgatgggtatcggcgaagtcgatatctatatcgggaagatcggaacgggaaatgtcgataaagcgctggaagagaaggcgatgcgggagcgggtcaacctcggtaatgcccaggaggtagcagaccaaagagccggctgaagagccgcgagccgggccgaccagcatatgcttcttggcgaacgcaaccagatcggcgaccaccagaaagtagctgtcgaagtctttcagctgaatctgcttgatctcttcttggaatcgatcctcatactcctgggtccattccttgatgtggccgcgactgaggcggtaggcttgcccctcgcgagccagagcgacgatatcaccatccaagtggatcatcggcgccttcgccagtttcacatccgccaactgctcgactaccgcacgagtattggcggcggcggcatcgaactcttcgcgagtcatgatgtggcgtaaacggctccacaactcctcttcggtggcgatgtggcgaaggccgaccgattcccgcaccttccaggcagacgcgaaatcagcatggtcgatggacggcatgtcgttgtaagaggtaatcaccaccggctttccgaatgctctggacgtctccatagcaccgtgcgcggcgaccatcgacgcgggattgatgtcaatgtagtcgattccggccagatccagatgggcataggcctcgccagcgaatttgatgacgccgtcagcttcctggaattcttgcggagtcaatccttgattctggaccgacttggaagtcaagcggtagaacttcttagtttccttggcaagcacccaggctttgagcttcagctctttttcgccgtcgtcggcgcatttgatcggaatttccatgccgaatccgcgaggcagttctgctttggtagcagcctgctcccaacggacgtgaccccaggttccatcatcgacgatggcgacgaatggggattcgatctctttggcgcgctcgatgatctccgggaatcgcccatatgcggcgccgtaggagtagccagagcgaacgcggagttgagggaaagacattatgcggcctccattgcttgatatgcccgatatacgcccatgcgcttgcaaacttcgtggagcagccgcacgtcgtcgagcgcccggtgtttctgtacatatgggccgcagtagtgctcataaagatgctgcagccgcatgcggtggccgaacaacggcgccgactcttccacagtacagatatcgagcgatgggaaattgacttcgtccaggccgagcttgccgcgagccagatcgcaggtaagcatgaacttatcgaatggaaggttgtgagcaatattcgcgtcggctctggaaaagaagtcgcgaactttctgacgctgatcgaggaaagatgggtgcttgatcagatcttcgttcttcaaccctgtgatcttggtgatgatttcctcgataacgattccaggattgcagatgaactctacttcatccaaaatcttttcaccgtcagttatcacgccggcgaattcgatgatcctcggctgcttcctcaaactcaccctctggtggaacgggagtcctgtggtctcagtatcccacacggcgaatatcatgtttgttccctcttatgtcgaaagggccggctgctttcgcgaccggcctgaggagtataccgcgacggctgaagatttacgccttctgtccgtctttcggcgtgatacggccggagcgcatggtggcgtggacaaacgccgaatagttgatcgagtccaaggccgaatcggcatccttgaacccgctattcgccaggcgagtgagtttgcccaccatgtgcatcacgaacagggcgagtcgatggtcatcggcggttttcgccaccaggccgttcgggaagaggatttccatgatctttccgtacatcagatcattgcgaccataggtgctctggcggtcgcggaagacttctgctgcggcgtacagattgttgagaacatcttccgcgaaatcatctggatgggaatcatcttcgcccggccagacggattccatggcgaacggcgcggcgtcttcggtcgggtcttcggactgagccgtttcagcgagcggagacggggctttcgcaaacgcctcgtcgagggtaggggcggagttcggggcggccgggaacggctcgcctgccatgtcgttgggcgcgctatcggggtcgctatcggccgcgacggcgaagaacggcgcatcgcaaccttccaggttcaggatgtaggagtcgatccccaggctattgtaggcatcgatgatgtcctggcgatcatcgaacgccgcgacgatcttggtgacgccttcgattttcttcagtatgtcgagcgcgactgcccgcttgaactgaggcgccggctcggtgttaccatacggccgcatgatgagttcatactcgcgatgttcggcgatgccgagttcgcggtggagcttggccctggtctggaaaaagtggttgtcggttcggccggtgacgaagaaaatcatgaggtcggcgtcgatggcattcctgatgcgacctacagcgtgcgggttgagagtgtccttgtcgagacgagaatgatactcgtcccattgccgttccaaggcgaagctcttgcggtggctatcgtcgaatacgcagccgtccaggtcgaagatgatgatgccattctttggtttgcgttccatattcagatttccttactggttgctttctgggtgacggttttatcgatgaacgtcccatcagaagtgaggcggaaaacttcgccattctggatgaaatcgaacgattgcacgttcatcgtgatgcgaatggattcgctgccgttggtcacttcgacttgtgcgatgtcgccaactttctcgacaatgatcttcatgttacatggacttcccattgacggccacagggttggcctcttgtttttccgatccccagaaatcgcggcgcagttcttcctgctcggccgagcgatccatccaggggcgatagaacttgcactggtagataggttccaacggaacatcaatcacaggaatctgacctggctttgtctccagagcggccatgaaccggtcataggatttctgctggatttcctcttcattcatcaccttcgacccatagcgcgggaaggcgcaggagccggtggcgacgcagtgcggctggagcaggctgtcgaacataggatagacttccagaaccagccggcgcatttcgcggaatacttcctgatattcaccctgggtccgaacgcacaggcgaaccttcgccatgtcgctgagagtccgcagattgaacttggccgcgatcttcgtttccatgttggaagggatgatggcacgagcgtcctggagcgacgcgccggcctccagaagcttctggtagctggtttgcgcgtcggcaatggcgtcatgccacagacggttcagctcttcgcggacatggtaggtcgggtcaggctcgccatttaccgtagccggttcgtcgaattcccagcggaaggcttccggctgaacgacggcgctgatttccagagcgcgactggtttcctgctggtaagccccggtacgagtccgaacgagttgatgggtgaagttcttgctgacaccctcgatctggaaaatgaagtccacgaactcgaacggcgagcggatggtgtccagcatgtacttccagtggtcaagcttttcggcctcggtcatggtcgccgggtcttggccgcgcatgcgagtggatttcgtccccaggagaagttcccaggcgttctgggtgtaactgatcagagaaattttcatcagaaatcttccggaattggcgtgaagtggaattttttggttagagccagggccaggccttgggcttgctctttacgaatgccatactgctctatctcttccttgagcagttcgcaggcctccagacgcgactcatactcttcagcctcctgaacggatgagaaaacggttccatcagaggttctgtacacaagttcaatcgacatgatgacctcagtagcagcggatgatttcggcgcggatatctcgacggtcgaggtagtgctcacgaatcttatcgcgggcgcgctcggcctcttctcgactgccgaacgacaggttgaacgaagtgaaaggcttatcgtccaggcgcccatcgccaatcaggtacaggatgcctaccagcacgaaagacggcgctgtctgtcgcgtttgcggcgggtcgatttgcatttcgaggaaagacatgggaacctcttcaggatgatctggtgcgtacattaatagcgctcctgctgagcagctacggtttccggctcatagatgagcatgtcaacgatttccgggcactggcctttcacccagtcgatggccgcgaccagtgtggtggaagcggagaaagagaaagtgcggtaagactcatggatgtacggcgaccccatcgaatcgcgctcggtcgtgcgagaaatgactgctttgatattaacgatccggcccatcttcggcctccactttagcgattatatctgacaggctcagtttctcgccattcaggaaataactggcgcgaaacttcctgtcaccctctggcccgacgatccgggccgttatggtgagactcccgccgccaagggcatcggtgtccctgaagaaagccagcagcgcccgcttgagcgctgcctcgcgaggatcgacggccattaacctaccacgttccagccgtgctgagcgcaccaaaccgcaccggcccctgcaggaaggctattcagaaggaacacaggagtcaggcgaccgtcctcggtcatatgtatgaagtagcgggcgccttcaccgagccactcggccttggcgatagcgcgttcgagattggccttggtggcgtaggttttggtgtggttcttgtcggtggagaaggttacttcgcgggccatttgtagattccttttggttgaagggtttcgcgtttcgatgagggaatattacgcccacctgatccagaagtaaagcacttttgtaaattacttcacgaacattttcttggccttctgataagacgaagaagtcatcaggcgctcgatgacgtccatgtccgaaaccagatcatccagaaggacgttgcgccaggtagcgaaccggccgagcgagaagatgccagcctcatgggtgagattccagatcatggattcgcgctcgtcgcgaccgagcggaatgattttgcctttggtctggatggtcggctcgccatcttcgatgagctgtttccttctgatgccgaaggccgcgcaaacgtaatccatatcccagtcgctgtcccattcgatggtttcgattttaccatctaaagtctccactatccctttagtgatggattcgacgatcagagtatcaccggtgatggacgctcgaaacgttcccactttaggaccagggaaatacacggtctggaagacatcacaggggatggagagcttgtatcgactcacgatgatggaggttccttcaccgaatgacgggtcgattcccaggtccagccctgccgcagccagattggcgcggaacggcgcggtgctgatgatattcacgtggtcatcttgccggcgaagatactggaagaaagaggcgtcgaaaggacggctccaagtgatacgattcgcaagcttagccaccagctgctcatagtagtcggccggtgcgatccaacgcttttcagtcgccagattccagatggaccggtccgacaggccgcccgttactttcctggagtacatgttgcagtggtcgatgcgcggctgggaaatgaactcgccatcaatgtagatggccttgtgtacggtgacttcgcggaatgggatgccggtgagttggccgatgactggtgagcggaaccgcaagagcgcgttgtggcgttccttgctcgtcggcgtcgccgcgtcgatgatttgggcttgaggaaagcgatgcgcggcgatcaggccggcgagtccggctcctacgatgattactttctgatcaggaatcatgatgtgtcccttatgagtgtacaaaacttgagaggataaaaaagggacccattttcatgagtcccttgaagagctagacgattcaggctcagaggagcggcggcttactcctcctcaccttcggaaccatcggcgccctgatcttcaccgccgtgctcctggccttcgtcatcggccttctcgtcatcgccctggccagcttcgtcttccttcgaagcgatggcaaccagatcgacccagcccatgatttccagcttgctcaggtagctgcggaccgaggtgccatagagaagatgggccaccttatcgccgaaggattcgatttcgaccggctcaccaacggtgcagtgctcgttgatgtgtgcgaacaccttgccgcgagtcgagaaggcctgcggagtgccatggccgtcgccggtcgggatgaagtgagttgcgcgggggcgacgcgagccgttggacttcaggtcttcgcggcgggcttcggccttcttgcggcgctcttcctgctcttccttgcggcgctgcttctcggcttcgcgctctgccttcttctgctcggccaggcgcttgcgctcttcttcgcgtgcggctttctgggcttcctgcgcggccttcttctcttcggccttcttggcgcgctcggcttccttctcggccttcttctgctcgcgctcggcttccttcgccttcgccttctcggcctgctcagcttccttcgccttggccttttcagcgcgctcggcttccttggcggcggccttttccttcgccttctcggcgcgctcggcttctttcttctcgcgctcggctttgcgcttctcttcgcgctcggctttcttctgctcggcttccttggccttggcttcggccttctcggcgcgctcgcgctctttacgttggcgctcagcggccttctcggccttgcgcagggcagcggcttgttccttggtcagctcttcgccttgggcctgttcgttctggttcttctgttccatgttcttactccgggaatgtttaaagggatggcttattggcctgtgaggggattatctctaaactaattgaagaagggaatacccttagcctgaactttcctaaatattttctttcgggaaagtccaaactctagggaacttatttatgttcgagaagttcctagcttttacgcaagaacagtaagtattcaattgcacgagtgatcccagtatacatcaactgactataagggatggacggcaagttctcttccaacatggcgactcgtttccactccgacccctgcgacttgtggaacgtcatcgcccatccgaagtcgaatccgccaatagccttctgcgcctccagccgcacgtcttcctcggccgaaaaactcagaggattgaacttcacccagcgttcatagttcgtgccgataatacgaactttggcgaacaacatctcatcaggctcgtcatcatcttcttgcccttcaggaaccggcttgaagtccagcagaatggcttgttcgccgttcataataccatattcgtgctggttcccagtgcacaccagcttctcgccgattcccggctgcgcacctttgtagccgaggattcggcgagcgcgtgcgttcaagcgacggcgagtattgttgtaagcgcaaagaattacaccatcgttgtccaggaacgtccgcatttcatcatccgacatatcgaagccggcccggaccactatgtcatcatactcgcggcatggcaagcgcttgccctggcgaacaaacatcgacgcccgaacgatattgccggcgttgcgctcgatttcggtcatgatggtatcacaactgttctcgtggaagatctggacgccgcgcacaggaggaacttggccaaagtcaccaatctccagaaccggaattcgatgcgacaacaggcgctcttcatcccactcgccgatcatagacgactcgtcgagcactaccaacttcggtttctcgtcgagcgagtctttgttggcaaacatgatttcgccgtcttcatcttcaccgatgggtcgatagataaagctgtgaagagtccgggcattggtgcagcctttctcacgaagacgcgctgctgcttttccggtcggtgcgatgaagactgtccagtccatcgagcagcaaagctcagcgatgatcttcgcgatggaagtcttaccagttccggcaaaaccggcgagtcgatagacctggcggcggtgtgctcgatcacaccaaccgcgataccagtcaacgacggaatttatcgcgtcgatctgctggctattgggtcggaatccgaatcgctcttcgatctgatcgacggtgaagttagatgctgacatatttgcgttctccaacgctaggtttaattgaattgaggctaagtttaagcaagccgtccacagaccatccagtatcacgacgatacttgcggccgtgcggatcgacatagaagtttttcgtgcggcgcaacagaacataatgccaagcggcgccgagtgcgtggacccttcctttatacgggaaagccttcgcctgctctgcggcctctttggccccagggagccagcggacggtagaaaggaccaggaccgcacccttaatagcctgggaagcggcgcggccgtcctgtgggctatagcgatgtctatcgaagtctacccagtggtggttgccgcgccggagcttcaccgtccgggaccggccctcaaacaccacagtgccttcgtgagtaaaaatatgttccgccatggaatgttccttataacgtacagttctgctttacctctgcgcaagaagagtatactatcagctgactcgtcaaagcgagcgaatttaatccaactttacttcggcaggaaagtggccgatactagcgccgccgcctgtactgccctccaaaacagaggatacattaaatgcaagaatgcaagatttcccgcgaccaactcccggtcggtaatccgaatcccaatgtcgacaagacccgcgacccgaaccttaagcccggtttcctgcgtcgcagccgcgagctggacccggcgctggccgttcgcatccgtcgcgagctgatccacgccgaagcatccgacttggccaaggccggatgggtcaattcacagtccagcctctatggatcgaaagccttcccgcgccattccgtcgttcgcgtgaccggagttccggaagatggagctttcatcggcatgctgatcggcttcatcgagcatcgcgagcatggcgaatgggcggtcatggaagccggaacgaaagaaggcggcgccgtcattattccagtcgatcacatcatgcgagcgtcattcgccgaagccgaagagttcgccgaaaagtgggagcggaacttggggtggcgtctcctgcgccaactccgcgagtgcggcgccctggccgggactgaagacgagttcctgcggcggatcatcaatcgatacgttcgtgatcgcacgatcctcgatcaccacaaagtcggcgcggacaaaacctatactgatgcagtactcaaaagcatcggcgaaacatggccgaagattccttcggggaaattcgtcggacaccgagtcgcgcagctcctgatcggccacaagctaggtcgagcggggaccatcctgaatgacctggtggacttcctggagaagttcgcggccgggcgcgataaagttctcaacatcgccatctgtaattgaggtgaatgaaatggttgacttggaaaagctgagtccaaagctgagtcctcggcagcatgccgttctactggagatgtacaggcatcctgagcatccagttcacagatcgccaacgaatttaactcttaaggctttgagacgaagggggcttgtcgagctatcctggaaggattccgtggctggatatatgttcggtcgccaaccttgctggaaaataactgatgccggcataaggcgaatcctgggagtgctggggaataatatggaaaaagaacaaagcgaagatcgcccaagcatccctgagtttgagaagaccgacgccaacaaactctatgatgctctggagacgatttcgctgctggagaagaagttggacgaatccgaaaagcgcgggagcgagctggccgcgagctattgtgacggcgtagtcggcgatgaatacggccatccttattgtcgttataaagtggaacgcgacgccgccttggccgaagtagagcgcctgctagaaccaaaaggcgatccctctggcagcttcgacaggtgtatgaagatgatgtacgagcgcgacgagaatgcaaaacgactcgacgccgccttggccagggtcgcggagctggaagggaagttgacggactgggtgcacgaagggttccggctcaacgaggcgctagcggtcgccaaggctcaacccagcgtgccggaaatatctggcatcggtcgcgatgccgaacatcccagagctgtagtgctgtatctgcgtaacgaacccagcgatgaagatatgcgagcaattcagaactttttgcgcgccatggccgcccccgctcagcacagcgtgccgaaagcatggctcgacgttcaggcagagcgccgccggcaggtcgaggcccaggcgctaaggcaggaagtcgcagcactgcgcgcaagggcggatgttgtgccggaggtgttcgggcttgagcggtaccgcgtagaaaaaactgggaagggtttctggccatactgcgtgcgtgcgggggatggaacgcgtgaactgttcgtcggccacttgaagcagtgtcagcgggtagcgaccgaattggctacggcgtttgaagatgggaagtttatcgccgcgcccggcagctcggctcagcacagcgtgccggaggggtggaagctcgtaccgatggacccgacatcgcagatgacctatgtcggtcagtccctgcgttgtgacgcggtaaacagcatcggcgagatttaccggcaaatgctcgccgtagctccctcacccatcgatccggccgcgcatcctcagccgtgccagcaaccacaggcccatcctgcccgctgcgggtgcgagcggtaagtgccaagtaaggaattcatgtaatggaacagaagaaaccttcaccagtagatggagtcatcatgaccagcctcgacgttctccggaaagcacagcccgaagcccaggacgagtatgccgtgtccatgttcgcaacggcgatccgccagaaaatgcagcgctcccgcgataaaggccgaggcggctggatcgactgcgacgaagatattctgatcaacggattcgccgaacatgcgctgaagggaaatgagaacaacctcttggacctggcgacgttcctgatgttcatgtgggtgcgcggcatcgacgatgcgaagattcccccggcgctcgaaaaggcgcggcagcacaagatcatggaagcatggagtcgggtccacgaagatggactaaactccgccagaaaggcgagtgctgcgcgacagttcgtggaagtgcctcgacgcaaggggcgcccggagcgacttgcatgaagcctcacgaaataagactggcacaggccgaagagttcctgcgcgaactcggccgagggattccggacgacgaacgggtaatggtcggctacgctgaagaggccacagtccaaaccgacgagaacggccgcaagctcaacgcaggctggtggcccgtgccctggaaggaaggcaagtacatcaattccaggtcaaacgcctacgcctgtatctcgtcttccatcaagacgcccaacccgaagaccggccagatgcgatactggcgcggcgaggcctctttcggccacggcctggcgttaatggtcgatgacatcggctccggcaaaggttccaaaggcgacttcgaccgcgacgagttccgagaacgcctggagccgaccgcgattgtggagacttcgccgaacaactaccagttctggtatttcttcaaagagccgatgtcccacatgcttcagtttaaggcattgctctattcgttcgtggaccaggtgctaaagaaaggcggtgacaacaccgtcaaagacgtcagccgttacggccggatgccattcggcttcaacaacaagcgcgggaaagacggcaagttcaaatatgccgacgaaaacggcaaacccgaactcgtgcgcctgtacagcgccgactattccaagcgctactcgccagaggaaatcgcgcaggccttcggcgtccgcatcattatgccacagatgaagaaggtggagataaaccgcgacgattgggtgtatgaccaagtatggctgaagtatgccgagcacatctgcacgaaatacaagatgggagaagcggcaggcggccaggtccagcagaatatgtccggcaaataccgcatccgctgtccctggggcgacgagcacaccaacggcgatcctttcggcgcatactttcgcggaccgatacctggcgccgagcacgaatatgtgttcggatgcgggcacgatacttgccgcaaagagcatcgacggacgtgggcggccttcactgatgaagtcgtcctgccctatatcgtcgaacaattggaacgcatcaaccgccgtcatatcggcgaggagtagtaactatgcaaaacgatcctggaatcctgattaccgccatcggcttgctgttcctcggccttatcatcttcttcgaaggcctaaaggggtggaaaatacaagtcgcaaacttcctcgcgtcgcttctgtgcttcttcttcggtctttccgctttgacgttctggttcgtcgttgcgtttgacgtattttaatcgacgaacggtacagaaattttcggatggggacggaacttattagctatgccggtttaggtaggagataatagccgtccctttcgcctcaatatgtagaggcaatgttgaatccgatcatgtaaagcagaaggcggcaaacctaacatgattatcgacgaagataatgtttttgatgatggcgaatcagggtccagtgagtttgatctcacacagatagaagatgctggaatggaccctttgatgaccgccgcgagcaaggcggccgatgatgcgattgcgaggaacgaaacgcatcgcgcgcaaaaggcggcaagatacgccgaggcgtatgcggaaccagacttgagaaagcgagcgcgattgttgatgctcgaccaggcgttcgatcttccggtcagccgggtcgtgaaagggccgttcgatgacttcatcacgaaatacagctcgacttccgacagcaactatctcgcggtgtacgatactttgttctgtaagggcgacggaaccgtcccacacccgcacttcgacgagtttcgcggccggctggtggaccatcgcggcgtggcgttcaacaacaagaccctcgatccgattgacctgatgggcgccctcgcggctgcggccttggacgatccctcgattaagaagacgattgagacttgctgcgtgtgggcgcgtcgatatcgccgcaactcgctgatcgagacgtttgagaagaagataccggagtgggatggagaagagcgaattggcacgctgctgatcgatctttttaagccattcgacaccgaattgaaccggatggtcagcaagtatttctggctgagcctgtactgccgcatcaactatcctggaatctcggcgccgatctcgctggcgttgattggtgggcaggatgcggggaagacttacttttcaatcttgatatgtaaagagttgtcgagcgaccgaaagttatcgccggtccagcttgacctgagccgtcatgaccagacgccatttttgcgcaatatcactggcaactcggtgatcgcgaacgtcggcgaaatgtccggcttcaaaaagggcgacatggaacgcattaaagagttcctggtgcgatccgatgatactttcgatcagaagtttgaaccaggcgaaactatcagccgacaatggatcaccatcatggacggcaacggctatgatggtcttcaacgggatgagtcaggaaaccgtcgattttatccaatgttcgtggcgcaacttcccgacgaggatggcaagccgaattgggttaaaccgggcgatggaaatgaaactttccgcgttgacttcaccgacttcggccgcaaattctggcaagccatggctgagtgccgcgcctggattaaggcgaatggcgtggagggatatctcgatctagttcgggcgaccaacaacgaagtccagaaattctctatttcggaaatggagaatgcgcgtggcgtggttcgtgacgatacgattgacatgtatctgatcaatgttctgatcagttgtgagttcgaagagatcaagcctggcaggaattcaaagaatcctggatggagagtcaacaccatcgaaatcctgaaatggttcgatattctcgccaggaagaagccgatttctcgccacttgactccgcacctgaaggcgctaggatttgttccgaataagaatggcttgaatggctggtgcctgcctgtagataaggttgcgcctggatggaccagagatatgcacacgacgttgccgccgttcaatgatgtgcttgtatacttgctgaggaaggttgattctgaggtgactgatgaagaggcaatgattcaaatccgcaaagttaaggccgagcgcgcaaggatattgggtgaggatttctgatgtagtgatggagtgtacttggactaggccgccttcgggcggtcttttctttggtgcggagtacattcgatttcggttgtggccgagtgagattcggaagctatctggtaattagggtttggtggcgatggcggattgtggaaagttcgtgaacgttggatcaaggattttgtgcggtgattggatgaattgtggaaaatcgacgattctgactggatttttggggtcggccgcgccggtcttactggtaattaccgaaaccgggaatttgggtcgagccttagtgccgcgtgggcttgaagcgcttattcggatacttcccggtttcggatgcagccgcaaaagtatactacagcgaaaatcgattgccc

SEQ ID NO: 22 - DNA, 73689 bp, Podoviridae Litunavirus
  misc_feature (1)..(73689)
gccgcaggcgccgaggctcactactcccccacctcaacgcacgtgaggtttatccccaatgagcaatgaagcagtactgaacatcaagctaccaggacaagaactggtagagatcgaccttggtatctcctggcatgagtacatcaacaatacaggagatgacaacactggcttggtttacgtcaagctggctgagtacgctgaactgtttgatgtagtacctaacaacccagcagagaagaagatagctgaactggaagccaaggtaaaagaactggaggacaagctccaggctacctctactgaagagaacagggagagtttcctgtgcagggttgccagtcgtggttctcgtaagcatgctgacatcgttaagaagggtggcttgttctactgggtaggtaccatcaggggtacgacactcagaatggagagtaccttcatggatgcagacttcgatcctgtcatccgtgatgcaagggattgggtgaagacacctactgtaatgagcggcggtcttggtgtactggtcatgagtgatcgagcaagaaaccacagactggaactctattggtttgcagctactggcttgttcactggtgtagccactcacacagagactggcttagcctacgtatcaccagtgaagcataaggactggaaggaagcatggagagagcttggctgctacatccaaggtaaagactagggtgtgtatatcctgtggataacttgactatagatatccacaggtatccataacccatagcttcggaccagtcatcctgctcacctcgctgcgctcggtgcttggcgacttaacctcagctatgggttatgggagctagggggaaaggggttggcttagagagagggaaggtgatttgggttaggggaattttgctcatagacttgtgattgcagtacttcagtctgcggctctccaaatccggttatcccccccggtacctctagagttttggaattcccgcgctacctaccccaccttgtttaactctccttctacccaatcatctgtctgtacttctagatcaagagaagccttcggctgtgctgtggattgatcctgtgtcaccacaaccattctcactactctggagtactaccatgttcaaagctctcaaccaattcttcgctatgctggagtccatgttccgtgctgtcaccaacctgaccaaggctgcggagaacgtaaccgagtgggctgaagaagagtctgctcacttcaacaacaaggctcgtctgcaacgcgaacaagccatcgcactgctcaacatcgagaacgctgctgaacttcaggagaagggtctcaccgaagctgtcgagtccgtccgtaaagaacgctccaaagccaaggcttaaccctgtctacccactacctctactccctaatccggagtagaggttaccttttcaaagcacacataagatcaagaacacacacaaagcacacacctctctctcagggacagtaggttgtagggagatagggatactctctgtgattactctctactcttcacagtcacttacctcgtgtgtaggaggataggggagatagtggtgactggcagtgcatcagttgtatatctctatcttcatcatctctacctttctcaaccctataccttgtcatcactttcccttctacccgatacactccgtgtccctatctctacttgggtagtgtctgatgttcctctacaccttcggtgatggagtggtattcgattctgtacttacttcatagtcctctataggtatcaaccatggaccagaacatctacacccttctctacaccaacgagtgtctccactccatcgaacatgagttcgaagctgtctctgatgaagttgctcgtatcaaggcaactgccatgtgcagaggtcaggaaggactctggtctggcatctacctcactgatcctcaaggtgaagcaatcacctttgatcccttctgactggagttcctctgatgtccaatccgcatagcgtgttccgtgtcaacaagtgtttcgtacgtatggtcaccaacggagaactcatcacatctcctaccatccacaacctggaagagatgcgtgactacatccgcaacaactgtaagccaactgacacaggcatccgtctctcctacatgtctgagacagaaggctgtgaagtaatccttgctcgcttcgatcacaacgggaaggtactggtatgaacactctctaccataagatgcaggaacacgtctgcttcgtaggcttcactcgtgatggtgtcaactatcaaaccaaccgtgttcgtactttcggtgaagccagacacttcatcaccttcaactgtaggcccagtgacaaggacatccgcatcttctaccgcattccctatgaaggggcagaggatgtggaagtggtcattgctcgtctggacctcaccgaaaccaaggagaacaactgatgatgtacaagtacgctcgtatcaaacgtgtccgtaatatcaccgtttatgacatcgcgtgccagtgctgggcaagggatttccagtatgacctgtgctgctatctgttgatccagcatggcttcagtcccatacaatccctggaagaattccagcgtgtctggaacaaactggaccaggagtacgtagacttctgcaatgagcatggctgtcccgctgaccccattggctttgctgacgtgaggatctgatccatgagaaccattgctgaactgctcaagattggcctggaatggcaacaagccaacagaggggaaacctacatgtgtttcgtcctgagtgacctggcaaatggagtggtagttggccctccaatcacttgggatgagtaccggtccttcaagaactggttgtgggagaaactgcacttccgcggatctgactctgtactcggcctactggaacgagcgggcttggacgactcagaagagaactgggttcagttctatgcctgggcctactacgacctcatcaaaaggaacacccatgagcaccaaccttaatctcactggccgcctcttcgacatcaagatcatccctaccaatggaaagctgactggcttccgtgtacgggtgaccttgatcaacatggactgcccgaacactgtactcacccacgtagttatgtgtggtgatgagtacaccgccaagagcctgaagactgcgatccttcagcgtcgtcggctcaacctcaagcactggcattggacagaggtcaacaaagaccttcctggtgcctgcaccaaccgtctcaaaaccaaaccaacaaccctggagatctaactcatggtagctatcgcttgcttcgtcctcatcgccatctgtgcctacttcttcatggtcaagtgcctggcctctctgacctgcttcggtgcgctgttcgtactgccaggggccgagaaggtagctgccctgcttggccttgcctggaacgtgttctgggcagtggtctggtgttctgcaatcagcttcctcttccaccttccgtaaaccaaggagtctgtcatgaccatgatccaactgttggccctcgttgctgttctactgctggtagtacccactgtgctgtccttccttcgcatgctcgtatgggctgccgagacgtgggtacggtgtgagactggccgtggtaaccgtggcactgctgcggtagccactgtgctgtatggcgtgtccatgtgggtatgcctgtacctcttcttcctcgtgggggaatacctgtgatcgtactcatcatgtccctgctgttcgctgtaggtctgtccatgctggtgatcggcctgcacaggcagtgggtgatcaacgagatgctcaggtttcccctgagtgtctcccgtcgccatgacctgtacatccagagaacccatgcctgggtcattgctgtctgtggccttggcctgctgttcgcaggctgtggtcctctgttcatcttcctcgctggaggtctgctgtgactgacgtagaaatcctcatcctgttgtgcctgtacatcgcttcgtctgtggccgtcctgaagggctacatgaagtggtccagtaacaactacaccatgcaagccacttggtttggtctggtgatcgacatcttcgtgatgcacatcctgaccttctccgggatgttcgcgctcatcggggcagtgtgcctcgtcttcagcttgagcggtctgctgtaagtcctcatggcctacggccatggggtggtaatccaaccctcataactcactgtttacttaggaatttcatcatgatcgttctgaacacccgcaaagctacctccatcctcgaccgtggctatcgtgaatgcctggacgctgagagcgttgctcgtgaactgcatgccattggcatgtctgcggtcaccgaggaagacgtgctgaaccactgggctgactgggacaaagacctgtccgacgaaccccactgggtgtaagagcaagagcaggctacgcctgtgtaatggcttatctgagccgaaccacttctgatctgaatctactacctctcactacaaggaacctgaatcatggcactcaagaaatccaacgctcgtaccaacactgctgctcagtccgacgacacccgtgctgccagcttcatcaacatctccatcggcacccgtggcggtgatccggttcgcctgggcaatggcattccgctgcgcctgagcgaagccgtcgaagcacagctgcacgagtacctggccgaagccaaggacgacaaggatctggccaagcgcatcgagaacctgcgctcgcgcctgatcctgtccttccgcgtcgtgcgtgacaagtccgagcttcagctggacctgtaagagcgtccgcccacaccctcactcgatcctgagtagggtgtgggctggttttttagagtataggtttgggtcagttgaagagactgtccctgccatccgttccgatcaaaccaatgaaactcagctggtttcctgacgatgaagtaaaagtctggaatcggcactttctggctggagaaacgatatgccaactgccctcgaaatgctcatgagcggtactgtaagtggtcgtgaggtgactgctactggattagcggagcgaactccgactggtcgcctggttcaagacagggactacctgaccgagcttctggaagtgcacaagtacaggggcaggcacattgatgtagtcatggtggacatgacggaactggaagaaagggtgatggcccacatgctggatcagatccctgtcgtacagaagaaggtgcgtcgtcccaaatgggagatgccgctgcgaaaccatgaaaccaaccacctgggcaaaggcccacgtaacaagttcggaggcttcaactgatggacaccaaccaaatgatcttcgtgtttggcagtaacaccgctggcatccatggggcaggtgcagccaagtacgctcgcttcaacaagggtgctgagcttggcgtgggtgaggggccgactggtatggcttatgccctgcccaccaagcaccgtggacagaaggggctgttggtcacctgccccatcagtgacgtagccaaggccgtacaacggttcatggacttcgccaaggagcaccactacatgaacttccaggtgacccgcattggttgtgggcttgctggcttcaaggacagcgagattgctccactgttcagggatgcacccgacaactgctacttcgacactgcctggacttcctggctcaaaccaaccaccaagtactgggggactatgtaatgactcgtacctatctgaagcgtgtagtgatccgtgatgaacatggattgttcgttgccgatggtgacactctcatcgacgcactgcgtgaagtgaagctgaagaacctgctcaagcagctgactgtcctcgaccaagaagacggtcaccgctggatgttccagttcagccacgtcaacaaccacatcgtcctgaccaagcagtctcctgactgctgcgatggaatcatcaaaatgggggatctcctgtaatgccacagttcgtagtagggaacatgtgggaagtcttcgacaaggccgaccacttcatcgtgctgagcaacagcactctcacctctactggtgcagtcgtcatgaccgctggcatggctgctgaactggtagctcgcttcccggatgctggtatccaaaccagcgtaggcaagtacatcgctgagaatggaggggctggtggcatcttcggttgccgctgccaatccaaggtaggtgtgttccaggacaggcgtcactatcgggatccgactgacctggggtgtgtcagcaccagcaccactcagctgatgtggcgggcacaggagaacccaacccaccagtaccacctggagcagccaggacagaacgagccttggtggctgatcaaggacatcttggctcgtctccccgacaacgtaaccatctggagccgtccctaatgggatggcttcactctagtgcaatggaggtagttggcgatgaggatcaatgcgcataacaaggacatgtttacaatggcgggcatacgggaagcggagcaaaacatggcccgcaagttcaatacgatgctgatatctgactctttgcgtaaaggagagtcctgtctgtacatctttgatggtttgacagaagaggtattccgtaaagacctctccaatgtagctagcggtctgatgatgagtagactcaagagctacactgatccgttcaagcaactctataccaagcacaatggcaggtggttcgtcttcagcagtgacttcaatcctgttgcagagaagctagtgccacgagagatcatagcccaatcacttctgttcgattaaggaatcgttccatgaccattacccacatgctgcctgaagatatgcaacgcgccaatgagtaccgctttgctcgggcgcacattgacgggtacatccgcgagttcattcgcggtgacgaagacttacctgcactgatggagcagggaatagcactgttggagaagtatcgcaccactgagtacagctatgcctccaagaaccttcgtatggagactgttcgtaacctggatcttgagcacattgtgttcgagatcatcgtagcttctgcgtactgccaggtaccagacatgtttatcagcttcacagccaagctagctggtgtacttggcttcgatgacaaggctgacagcatcaagaccatcgctgagatggttgcagtgctggcagagcttgacgtgtacgacattgagcaggtgtccaagtatggtacatacaaggtcatctctaacattcaactaccggagaagcttcagcatgctgttgagcgagctatgtaccttcctcctatggtgtgcaaaccatccaagctcactggcaacaagtcgaagcttcatcttactctggagaaggaatcccttatcctgaacaacaaccatcacaacgaagacatctgtctcgatgtgttggacaagatgaacgctgttgagttgtgcctgaacactgagttcttgagcaccgtagaagaagagtcccacaagtacttggacacgcaggacaagaaagacgactggtacaggttcgtctctgaatcacatgagatgtacaagctcatggttcagcaaggtaatcggttctacctcctgcacaagtacgacaagcgtggccgtgtgtatgcacagggctaccacatcagtacccagggatcgccttacaagaaggccatgctcgacttggccaacaagaaagtagtcaccggtgtacctgaacacttgaagatcaagtgaaggagcaagcaagtgagtcactatgccttctacaaagaagacgatgtgtggaagttcgtcaagtacgacggattgcttgagcttgtgcaagctgcgtcattgatggcctacagcccaaaagaagcagcagcgtgtacccgctacaagctgaatggagtcagatggtggtggatgggtatgactgataaggatgctatagaggatgtgagtcttcttccagcagacctcagagcaatgctggtcatctggagtttagaccaactgctagagtgaaacttctattcacagtaatgaagaggacaagtaaatggaactggtggtttggaaagacggcgacaattggagagtgtttgctgatgatgctaccccgcctgtggatggtaccgtagacaaaattgcagagggtctagctactctctgccggaaagaaaaagaacctgttgtgttcaccaagaggaagactgccttctatgacggatactactggcttgcgtggaggtactaccccgcctacggacgtgcatacggcaaagaagcctcagaagaaatgattaaagaacccagcgttattgcactactcgcggggtactaaccaatgaacgtagctgcatggcttcacaatggtgagtggcatctgttcacgagtgagttgagcaggttggtgtcggatcaagctcacttccaagtcaacctgaaagaggaggagaaacgggataatgtacttttcaggctaaccacaaagaataggagtaccttctattggtttcactttagcatggacaaccttttcaataggtacatgcctgtagcgtataccgaagacatacctaaagaactacaagcactgttgaccatctacggtctctaataccaatcaaccttcgtttaatgggaactcaaccatgaccccttacaccgctttcgaatatctgctgatcgacgctgcaaaccaaatgggccatgacaagtggctcttcgaacagcgcatccaatggtgctacgacaacttcgacaacctggagaatctggagtgcaacgaaaagactcgtccgcagtacctcaaggctgtaatggccatccgtgctgcccagcgtggtgagcctgttggccacctcgtagggctggatgcctgctgctcgggcatgcagatcatgtccgccctgggtggctgtgagtctggtgctcaagctaccaacctcatcaacaccggcttccgtcaggatgcctacagcctggtcaccactgctgcctctacccacctgggtgagtcggtaggggagatcaagcggtcggacatcaagactgcaaccatgacccacttctacggttcgaaggctgagccgaagaacctgttcggtgaggacactcctgaactggaagccttctaccagggcgtggagatggtagctcccatcgccaacgagatgcgggatgacctgatcaacacttggcagccctatgccatgaagcactcctgggtgctgccggacaacttccactccatcgtcaagtcggtagacgtgttcgagactcgggtggaagtggacgagatggatggtgcaagcttcgagtacatctacaagcaggactgcggtgtagagcgtgcggtgaagaatgctgccaacgtcatccactccatcgacgcctacgtgctgcgttccatgcaccgtcgctgcaactacgaccgcgaagccatcaccaaggtaatgcagttggtttggggcgaactgatggatcgtcactctggtgagtgcgaagccggtgaaaccctggacgccaagctggccgtctacgaagacctgtacgaccgcaccaacatggtcgatgcagtgatcttcaaccacatcaaccctaccaacgtacgtcagctggagactgaccacctggaagctctgtgtgctctgtgggacaccatgcgggttcacgaacccttcgaactggtcaccgtgcatgatgagttcaagtgccacccgaacttctgcaacgagatgcgccagcactacatcaacatcttcgccgaactggctgacagcaacatccttgacgacatcgttcaccagatcactggaagccatgtcagctacgatcggtcgatccacaacctgtctgaactgatccgtgaaagcgagtatgcgctgtcttgaggtgagtgggcgtcttccagacgctccctgaacccgaatttgcctgatcccagaaatgggatcgggcgcttatttttttgaggggagcttagaaaccatgagtaaacacaggctatgcaagtactgtggtaagccaatagtgctggtccccagtgcggaagagagggctaataagttcggagagtctcccaagttctacctcaatctcttctatgcacatggagagtgcattgtgaagagcaggggttgagcgtactccgtacgctttttgcattttcgctgatttccagtgagttcattcaattgaagaaggagtaacaccatgcgcaaatcgtacctgaaattcctggacaccatggcttggatcgctgctgtcctggtcttcgtagtcgtggcagtcgccgccttgacagtctacaacggcctcgtggccctgctggtaatgctgggcgctgctgtcggcatcggtatgaccttcggtttctggttcctgggatacggcatctacgaggaactccagaagttgaacgctcacgtcgggagctaagccatgcaagtccgtaacttcgtcttcgaggatggcggctggctcatggaggatatgcataccttcgagccaggagatccattgacagtcatccatgactcgttcgagcacatcgacagtactgaaggtctagaagcggagttacgggccttcggtgctatgtggtggctccgtggtgagacggactggtggagtcgattccccggttcagaaccccgtcctgagcaggtgatgtactacgacatcgccaagttcatcatcgagaatgactttctcatcgacaacgtaggcaagcgtttcaagctgggagatgaagaggaagagttcctctcgcttcttcgtaagcttgtcgaagaagccatagaaagagaagttcagtatctctctaaaccagtggcaaggaaggtgatccaggaagcggcaagtaccgctatggattggcttcgtgttgggtacagggcagcccgtagaaaataccctgacaacttcgctgttgctgacctcatgtacgacatctatatgcgtgtacggaatcttcatgtacgtgcttacgagggcagcacacttcaactcaaatacaccctgaatggaaagttccttcaggtatatctagatggagaactccaatgatcccattcgtttcccgcaagcgtttcgatgaaaaagtgaccagcctgattgaaaaccatgagacggtagtacagcgaaaagatcaaatcatagatgtaatggataacaaaattcgggaagcgcgggaagaagcgcgtgttaaccgtcgtctgtatgcgcgtacccagagcgacaactaccgtctccagaaccagatcaaggatctgaagaaggcggtagaggcccgtgacaagaagatctcggaactcgccaagccattccatggggaccaggaaacagttcccgtactcgtctcggaagagacagtcttcgagcctgtggacaccggcctggaaaagcagctggctgaagccaagaaagagatcgagatcctcaaggacaaggttcgcaagcagcgccgtagcgatgccgaactgaccatggataccctcgtgcacgctgtcatgcgtgagtactccaacttccaacggagcaacaatccccacctgctgctgcgttcctgcgagaacctgacgaaggctcatcgtcgtctggtgaagggtaagcgctgatggatacgatcacttggtttcgccgtggtgaacccatcgaagttcccaccgaccgctgtctgtacttcctggctgacggcaagctggtgcagttcatgtatcacgatgaacggggactgactcagcttgcacatgtcaccggcctttctgtaggcaagatctacagtgcccttaagggggagttcgtgtacgtccgtcatggcttcatcgtcaagaacgaacgtgttggtttcacactcggccatggagaagactaccggcgtcctgtatgcgtttacgtgaagggtttcgagcacatacgtggttcactaactgccggtgcccaggaactcataactgcccagctgctgggggaccatgtgaagttctgcaccaagacgaacatcggcggcaccctggtaatgcttccgggagagccgggtgagcgtgtcaggaagaaggttgtaatcgaagagatcggtaccgccatccaccgcaactggtgtggcaatgcctgcttcgagatcgctgtgatcgacaagcatggccgacgctacaccgaactgaacgaccatttccaactctacggggtgaacaagtgatgatgatgagcgaagacaagttccaatacgagatctctgccatgaagagcaagatgcagcgattgcgtcgtcgggtagaagtgctcaacaacaagcgggatatcctcctcgaagatatcgattcagccaacaagatggtggaaaacctcagcagtcaggttgagtcgctgttgcaggaagccaacaaggacaaaggtccggtcatgcaaccgggacgcctgcaccagagtgacgtactgctcaccggccagaacatccagggtatgatggactctggggaagctgtcgcccaattcgaggtgaagaagggagacgaccagaccaccaccatcctgaaagatgcggtggtcacccagatgagcaacaagctggctgaactactggatgccctcggcttcggcaaggagcatgtccagaagcatggcctggaccaaactgtctacgatgcgtgcttgtacatccagtccctgaagggcggcgagtcgttgctgaacaatctgcgttcgatgctgaagtgatcagcgacaagctccgcaaagaattcgaagaagagtaccgccactgtgtgtggtccttcgccggggtagtcatcacccaggaagaactggcgagtaagcgtagtcgtctcggagactacgctgacaaccctttgattcatgggttcttccgaggctggctggcgggccgcttcggtgtagaagggatgatgtacctcacaggtgaacaggctattcattagcgtactccgtacgctcttgtcctgtttattatttctttcattggtttaggagcaagtgccatgcattagcagtaatactttaactaactccctgcgcatagcgtcgcataaggcgagacagtctaagtggactattagtacataaagagaatgccgagtttccaaactgcacaggatgcagtccctgagtaactgtcggcattctactgtgtgtattaaaccaagaattaagaaggagaacttatgcagttcagtgatctcagtccggtggagcagaagctctacccaactcacagttccttaaaagaagccctcgaagaagcgagacatctgcttcctgggggcagtcatcatgacttcatgcgagccattatggggtatcacaatacccttctactctttgtaggtgagtggaccccttccgagtaatatttggggttatgcattcccagatttattaatcttcccgtttaaaggagactatccagtgtcccaagccaatgaaaaaacaatcgagcggatcggcaagatccttctcatcttcaaagcctccgaaggcgagatccgtccccacttctggttgaccgggccttctggttcgggcaagtccttcaacatcatggaccagtgcaatcgcctggacatcatgctgcccatgaccgaggtcaactgtgcctcgctgaccaaggaaggatactccggcctgagcctgagcaaggcactggccccgctggctaccctcagcaacgtgcccaacgtcgtcttctgtgacgagatggacaagctgttcctctccggcaattccaacgacagccacgccaacgagatcagcatcggcgtgcagaacgagttcctgcgtgtcctggaaggcagtaccactcagaccttcggcgactacggcaagtacaacacggtcagcgtcgagcgatccctgttcatcttcgccggtgcgttcaatggccaggagaacatggatgccaccgaactgctgaagtgcggcgtcaagaccgagttcatcggtcgtactggcttggtctacaacctggagaaaccgaccatggaagccctggtccagtacctcaaggaatcggaactgtgggctaactaccgctctctgttcccgaaggaagaccacaagaaggccgagaagtggctgatcaaggagatcggccgccagtatcccgacagcaacattggcgtccgcttgatcaacaccttgatccaccagtactacatcaacgccggcgaagactccaagccccaatcgggcaagaaggagttcgcccgtaccctcgacttcagcaccgggagactgaaatgagcaagctgaaagacctgcccgtactgatcgaccgccctgggaactacgtcactcgtgatggttcccgcgtggttatcttcactgtcaccgagcgtcccgacggctactccatgatgaccttcgacgctcgtggcagctactccagggtcaacaacacggccaagcccgagtgctggcacatcagcggtcggctgcacgctttccgggagcacccgaaagacgtagtagccaaggcttaaaccaatcaaatcaatcgtttaggagtacaccatgcacttcccccaggaacaagaagtatccattttcgacgccaaagtcattgccgaaggtttcctgcgtgccggcctgaagccgatgatccacggttcgccgggcatcggtaagtcggcagtggcccgccagatcgccaaggaaaacaacctgaagctcatcgacctgcgcctcacccagatggacccggctgacctcaatggtctgccgaacctctctggcgagcgtgccaagttccaggtattcgaacagttccctctggtcggtgatgagcttcccatcaatcccgaaaccaatgaaccctttgctggttggcttctgttcctcgacgaactgaccagtgcggacgacgaccgtcaagcagcggcctacaagctgatcctcgaccgtcagatcggaaacgaagatctccacccgaagtgcctggtaatgggtgctggcaacctcgaaaccgatggtgccatcgtcaacccgatgtcgtcggccctcatcagtcgtctgcaccacatcgtggttcggaacgacctgaagcgctggctgcaagtcgtggctcccaagctggacatcgccaccaaggtacaagcattcctggagttcagccctcgtgcgttctacaccttcgatccgcagaacagcggtcgggtctatgcgtgtccgcgtacctgggaagacttctcgaagtggtttctgaagatgtccccggagcaagaccctcgtgccctggacgacatgctgaacctcgctgctgccatgggcatcatcggtaccgtggccaccgacttcaaggcgttcctggcctacttcggtcgcctgccgagcctggaagagatcctgacttccccgagcacgatctacgtgccgaaggatgagccgggtctgatgttcgccatgtgctcgatgctggcggataacgccaaggtggacaacatcgagaagatcctgatcttcctggatcggttcaacccggaccacatggtgatcaccctgcgtatggcttgccagcgcaacaagggtctcatccagaatccgcgaattgcggagtgggtgaagaagaacctgaacatgttctaaaggagaatccaatgagcggtcgatgggaactttttatggttcgtcaagaagatccgataggattggaaatagtcggcgaatacatgcgtaaccaagaccttcgactgctcactggagacttcgaaggctggcaagttaatgtggttgaaaaaaccacaaatgaccccgtagttattcggaataaagaagtactagaaaaactagcatctgaattttgtccgtacgtagttaccgttaagcccacagacggctcatatgtgacccctggtctttatgtgggtcactgccgtaataacagcggtcaatacactcagagttactctagattaggaggaaccgcagcttcaattaatgaagtagtggagctaataagaataaccaatcccctaaatggtcactggatatctgaccaagaagaagttttcgtggcccagtccctggctgttgtttctttaatccctgaaacccacaatcaagttgagtggtgcaagttcgctaaggcgatggcaatcatcggaggtgagtaatgagtgatcgttctgctgaagacatcgccctttccaaggcgaagatccgaatcatcggagactccaaggtgagtttctacgccaacatcatgatgggcctgaagtacgtgtgggaagagggcatgggtaccgctgcgatagacggtgtgaccatgttcatcgatcccaagttcttcatgtctctggatgaaacgagccgcaaggccgtgattctccacgagatcgaacatgtgtggcgtcaccacatcggtgagactcggaggggtgaccgtgatcccatgttgtacaacatcgcaggggaccacgtgatcaacaacaacttgttggcttgtggctatggccccatctcctggaccgactacaagaccggtgccaagtgcaactgggtgtgcgattctcgcttcgccgacatgtccaccgaggatgtctacgatgccctgtaccaggaacagcagtcgcaaagcggcggcggatccggtgcaccagaccaaggcaacagcggtgacaacccggtaccattcgatgacatttcccggcctgccccgaccaaggacgatggcacccccatgtccgagacggagatccagggagccatcaacgacctgatcctcagtgcggctactgctgctcgtgccaatggcaaccctgggtccatcccaggagaggtgcaggtgttcatcgacagcctgatgttccccaagctgcccctgcctcacctcctgcgtcagttcttccaggtggtgaagcgtggtggcttcacctgggcacgtcccaatcgccggctgatcaacaggtactacctgccctctcgtcgcggtaaggcactcctgcggattgccatcgcaatggacctgtcggcatcggtcagcaacgaagagatccgccgctacctgtcggagatcgccaacatcttcgtcacgctgaaaccaacacagctggacatcatccagttcgacgcttccatccgttcggtggatacggtccccaacctcaatgccctcatgaacatggagttgaagggccggggtggtacctgtattgcccccgtgatgcagtgggccgcagagaacaaacctcacgcattggtggtgttctctgatggggagttccaccactacaacgacaacccaggagtaccgattctatggttgattcacccgtacagcaggaaatcgaactggaaagccccgtacgggcaagtgatcctgttcgatccgaaggagtaaacaagcctgctcccttcgtactgacgcccggtcaggaagccgggtttcagaccttcatcagcttctactccaaccccgatgcccaggtaatggtcctcaagggctggtcaggaactggcaagtccactcttattcgtcgaatcctcgacgagatggagactctggatcgcgccctgtctaccctggacgacaacttcgagccgttcgaacccctgctgacagccaccacaaaccaagcatgtgatgctctggcggtggccatgaaggagttcaaccacgaggtcaagaccatccaccgggcattgggccttcgtctccgcaccgactacaagacgggcaagagcgaactgatgcccatccgcaacttcgacatccctttccgctgcctgatcgtggttgacgaagccagctacatcgaccctgttctgctccagttctgcttcgaccggacagactgctgcaaattcatcttcgtcggcgacgactgccagctgactccggtcggtaccaacatcatgcctgccttcgccatgaaggacattgtggtggaacttaccgaggtcaagcggcagaacagtggtcccttgttggacctctgcaacgctttccgccacacggtgaagacgggtgagtggccgaagatccagttggacggtgaccagctgatccatgtaccacgggacaagttcgtagagatggcggaagaagccttccagaacccccaggtgcacggcagcaccaaggtattggcttacaccaatgcctgtgtgaccgagtacaacaagcacttctcccaactgcttcttggctccagcgatccgcaggtaggtcagaagatgctggtgaacgaagccgtcatcaacaagcatgcccagctgtccaacggatccgaggtggtaatcgaagacattcggccaaccagagagtttgacgtggacggctacctcgtgaagctgatgcaccacaacagcagcttcttccttcccaagtccctcaaggaccgcaaggaccgggagaagctggctcggaaagaagaggattacaagatcctccagctgatcgaccagaactgggtagacctacggcctgccttctcgtgcaccgtgaacaagtcgcagggctccacctacgatacggtgttcatcgacctggacaacatctgtggcaaggtacaccgcccgaacgccctggcacgccttctgtacgttggcttcagccgagcacgcagacgggtggtcatgacaggggacatgtaatgcaagcgagaaccccggagttcctgatcttcaaaagggcagtgaaggactgcttggatggtttcctctatgttccagtgaggaaggcttttcaagccaagctgaacgaactgatcatcgcggatgctgtagctcgcggcgatggtatccgtgcgttctgccaccgtggtcgtaacttcatgatccctggagaaaagcccaatttccgctactttccccggctgagtcgcggcaaccgagtactcgtagacagtcttctgtccgagtacgacccggtgctgatagacgagcgtgactctgtactcacgttcatcagccaggtgctcaacaagtccgacgaaccgtcggagtacctcaagatgttcccaagtggtttacgggaacctctgaagagggtctatgagcactttggcttgccggtggaaggggtggaattcccgaccgaaagtcccataggttcaaaccaagcgggttgggataagctctgcacccgtgttgggattaaccttgtactaggaggactgtgatgaagtacatcacctgggaagaacaggatagctaccctgtggctatcctgatcaaggaggcagcggtgagccggtcagccgctgaatccacctacatcaagcaactggaagggcttggtgtaccccgcaagaatgtcatcgtgatctctctggattacgagggcaagaaggtatctgccaaggcgatcaaggagtgcatcaaggatcgcgaccagctactgcgggatctcggagttcagtatgcctacttggctgactccaagtacttcaaggagtggaccaagcggaagacagacgccgacttcggcaacttgtcgccccctgctggctacgatcctgggtacttggtgactccgggcgtgaaccatcaggtgttgctgttcgatccagggcagatgcacaagctcagccgtggcttcaaagccatcgttgaccatgccaatggagtgtatcggcccgttggatctgacctgctgcacgatgtcacgtacatctaccgaggccacgtaagccaagccaaggaagccctggccaagctcatggacaagccggagatatcctgtgatatcgagggcttcagcctcagcatgttcgactcaggcattgccaccattggcttcgcctggagcgagcacgatgctgtacagatccagtgtgactaccaggagatgttgcaggatgagaacaagcatcacgggtactacgagccgaacgccgaaatgcgggaagtgctcaagtggttcttcaccgagtaccctgggcgaatcatctaccatcgtgcaaaccatgacgtgaaggttctgatctacaccctgttcatggagcatgacctcgataaagagggcatgcaccgtggattggagatcatgactccacggatggacgacaccaagatcattgcgtacctcgcactgaactcaaccgctgatgtcagctactccctgaaagacctggggcaggaacatgcgggtaactgggcgcaggacgagatcaaggacatccggctgatccagctggacgacctcatgaagtacaacgcggtggacgcggtgacgaccgtatgggtgaagaacaagtactaccccatcatggtgcaagaccagcaggaagctctctaccacggcctgttcaaggacagcttggacctgattattcagatggaactcgtgggcatgcccatgaatccgaagaagatcacagaggtcaatactgaactgaacagcctgcgggacgggtaccacaacactgtgatgagtcatcccgcagtcgccaaggtagaggtgctgatccaaaccagtgaaatggagaaggccaatgccaagctgaagactatccagcatccgctgagcaagttttcgcacattcggttcaaccccaactctggtccgcaagtggcccgtctactgcatgaagtcctcgggcttcctgtgctggacgtgacagctaccaagcaaccctccaccagtggaggtacgctgaagaagctgctgaaccacatcaaggcggagccgtacaaggatctcatccaggccctgatggacttgggtgccgtagaaaaggtcatctctgccttcatgccagccttcaaggcgggtcgaatgaaggcggatggaatgatgtacctgcacggttcattcaaccttggcggcaccatctctggccggctgtcatcctcggatcccaacctacaaaacctcccagctggctcgacctacggaaagctggtgaagtccctcttctgtgcgccgcccggcttcctcttcggaggtgctgacttcgctgcactggaggatcgtatcaacgcccttctcacccaagacccgaacaaaatcaaggtgtacaccgatggctacgatggccactcgatgcgtacctttgcgttctggcctgaaaagtgtgaagggatcgtggatacggtggactccgtcaattcgatccagaaggtctacccagatctgcggagcaaagccaagactccacacttcctgctccagtatgggggcagttggatgggtctggtgcggcaggtaggtttctcggatcaggaagctcaggagatcgaaaccaactacaacaagctctatcacgtaagcaatgagtgggtggctggtgagatcgacaaggcgaccaagaccgggtacgtggaactggccttcaatctacggctgagaacgccactgttggggtccactattcttggcttgaaggcgactcccaaggaggccgctgctgagtcccgtagtgcgggtaacgcagtgtccggtcaatcctggggtctactgaccaaccgtgctgctgtggaattccgcaagctgctactggccagcccctacaagctgaaggtagagatcatctctctgatccacgatgcgatctacgtgatgtggccagatgatcctgatatcactgtgtgggtcaacaacactctttgcaagtgtatggcttggcaggacgatcccaagatcaatgacaagcgggttcctttgggtgccaacctggacatcttctggcccagctggcgtgaagcctgcaccctggactatcccatcaccaaggaacgtctcattgaacagtgccgtgagcatgctgctgcactgaaggagaaagccaagtgaccagtacctgctgggtaaacgaccacgagatcaccgtgtcgcaaggcgtaatagccgtgcgtaaggacggtgtgctcgtccatgaatgcggcggcctctgggctgcctgcgactttgcgagaggtatcaacagtgctgaaagccccggacccgaggtcgatgaagtacaggagactgtacatgtcgatagcgacgaatgcggccaagcagagtgtagctgaacgccatcaagttggaggggtgctggtcactacgaccggtgccctcttcactgggtggaacggcaccatgcctggaaccgacaactgttgcgagaacggcgagtaccttcgggaagagacccgcttcaaaaccactccctacggggtgatccacgccgagcacaacatcttggcttgggcgtcccgctctggtgtacccctggacaactctgtcctttggatcaccagggcaccttgtgttcgttgtgccgaaatgatcgctacacatggagttcatctcgtgctgttccgagatgatcatgatgaacccgaggggatgacagtgctggccatgggcaatgtgaaagccatgagttggagcaccctggactcccttatcaccgaacacgggggtcactacgttgtctcgaaaaccctgctcgctaactgaccggaagtcctactgggcttccttcaaccatatgatcaagcacttcggaggtatcgaagaagctgaggctgctatcgcttccggcaaggctgtctatgggaaaccaacagtgcccaagggttacatcttgggcaccgacatcaaaggcatgtacgtgctgcataaggagtaatcatggcgaagaaagccaaactgaaagctgattggactccaggaaagttgggtcatgcgcctgtcaacggacggtatttcttcgtcaaccgtgagacacgcatgacccacacctggacaatcggacaactgcctgttcccgaagggtatgagcaggtgtccatgaaagagtacgacctcttccggtcagagaaccggatgatgtccaagaagaaactgttgtcacacatcaagggagcagtaccgtgttcgaaggacgcaggaaagaaatccgggagcgaatcgaagcccgctgcaaagtcgaagacacgggcttcgtcctcgacaacaagcccagcccctgccacctctggcaaggcccggattcaggtacgggcaggggtggtggttacgggcggatgagcctggacggccagacagtggccgtccacatcgtcatgttcaccaactacttcggctatgtgccgggtaagaaacagatcgaccatctctgcgggcagcgactgtgctgcaaccccgcccatctggagatggtcacccacctcaccaatcagaaacgtcgcgctaaacgcgccaagtccaaggagtaatcaatgcaggtaactcatcagaaagactacgccactcacgttgtgattggcggtaaacaagccatctccatgggtatcagtgacgacccggccttcttccaagttctgtcgagttccctgtacacggacaagatccttgccgtcgtccgggaaactctctgcaacgcctacgatgcccacaagatggtcggcatcgagaaagagaccccggtcgagatcacactcaaggacgacgaattcgtcatccgtgacttcggcccagggatccatcccgacgacgttggcacgatctacggcgtctacggcggctccaccaagaagcacgacggctcccagactggcggctttggtttggggtgcaagtctcccttcgcctacgtggacaacttccaggtgaccattcaccatgaagggaaaaccaacgtctaccgcatgcagaaggcttccatccagaacggtggccgtcctgccatcaccccggtggtgaccgatatccctaccgaccagaccggtctggaagtacggatcaacatcaagaacgaagacgtacgtcgattcggtacgctgattcgccgtatcgtggccaacgccgagatgctggccaacttcaacggggtgaagctgcccaccttgcccttctcccaggtgaccgaagactggtccatcgctaccgagcaggtgctcgaatacaacggccacatcatctgtgtccgctatggtgatgtcatctatcctgtagagcgggatgagttcatcgccgaggtgtatgaccctgttcacaagttcgtgaactccctgccgggcaacgtcaacgtgctggtcctccaagccaaacctaactcggtgtcgatcacaccgtctcgggaagctctgtctatggaagaccacacccgcaagaccctcctccagctgctcaacaagttcctccgtgcaacgcggaacatcacaaaggaacgcagcgacatcctggcgaagtcctgtgaagaactggtacaagccaggaaaggtgcgatggtgcagcccgaagaagtaaatgctaatcgtgtgctcgtgagttccatgcgtgggtctaagctttgtaccaagggactcatgtctaccatggaagaggttggcttgagccagctgtaccattcgcacaatcgtagcgagaaggaacacttcaaggcactgttgaaacagctgtccctcatcggtaagcagccgagaaaccagggtaataccctgtatctctcgttcattcggttgctgaagaaagtaggcctggcagatggaatctcacactacgagcgctcgaacttcggagaactattgaggttcaataagtcatcctggcaagcactggaggtgcagaagtggggtcagaagcacttggtttccaagctgctgccactgatccacgaagagggactatgccccactcgcttggtctggtacggatccggtcggaatctccacaacggcgactctgtgcgcaactacaacaaccatgcggcgtatccgctggttcggtactggtcgaagaatccgatgtcctatgtgccgctgttccgtcgctgtattgtcctgactcacagccgtcgtgacatccacaatcgtgtggaggatcacgacgagtgggtaggtggttactgtgctgacgattccctaatcgcttacgtggttccgcgtagcgagaagaaactacaggaagccaagaaagcactggctaccctgaagggttggtcggtcatcgacctgacagaagagtacgaaaaggtggagtactccagctcgcattcctctgcacctgtggcaaccaagccaaggaagaagggttacccgatgctctcggcttgccagagcagcggcatcttctccctggagatggcaaggacggaatctgtagctcgggtggagaatccctcctactacgttcgtctccccaccaagagcgactactacacccgcaagtgtgtacgtggtttggacaaggtgtgctcagcctacctgctgaagaacttcggcgatgtgggtgcagttgtgtacaccgaaacccaagaagccaacatggagaagaagggcatcaaaagtgcccgtgacttcctcctggcgaagctcttggaagaggtggaaaaacctgagttcagcaaggcttgctctcttcgctacaccttgttgttggatgttgcgaaagatccggaatacgttgatctcatcaggaagatgatgcaggtggaagagtgccgtaaggtattcaaactgccggagcctgaagatcctgtggctgaagaattgctcaccacggtctattccatggactcccgtttcttcacgcaggagcagaaggagtccttggatgcactgggcaagaagatcaaggcaattcctggcgacaagaaggtgctggaaatgctgaagaagctcgctgaagcacccctggtaagccttctgaatacctcggaagtgcggcgtgcactcggcgataagaagactgtcacctcggcagtcaaactactgaaaacagctattcgtggctgaaggagaaaccaatgagcaacaaagtaactgtcgtaggtgctgtcctcgacgaaaggtatctgacgttgtacgtgaaagggtctgccgagcagattcgtatcccccaaggcgatccccgtgtcgccgtcttcgtcgagaagtacgtccccatcctgagccagggtggtgaagtggactactccgaagacctgctggtcatcaacaacgtctacgaagccgccgagaaaaagtccggtggcatcatgcggttcttccgcgtggcgaagaagaaggtcgcagagttcttctcggcggcctccgcatccgagccggctgctcccgtcgctcccgtcaccgctggcgcggttcctggcgactgcgcaccggacacggatgctgggcaggatgtaggggaagaggtggccgagaaggtcaccatcaaggatcccgtactggccaaggccgtcgatgacatcctggctcacgccgtaccggcatcggctccccagttcagttccgtggacctggaaaaccatttcgaagacggcgtagagccggaaaacccggatgacgacgtgggcgaaggtgacaccatcatcgccgtgaccgaccagggaaccatcgtgccggacgcccagaagctgaagacccagctgaccgcagctgttcagtcgaaagccaagggcagcactgtcggcatcgagaacttccttcgccgggctggtgccgtatctgccaagcgtcatcacagcgtgcaggacttgatgcgcttcatcgaacgtggggatctccccatcgccgatgatggttgcatcgtgatctacaagctgctgttgaagggcggcccggacggtcacaaggagttctcctaccgtgacatccactcgcagaaggtgccgcaaggcgtcagcactctggtgtgcatgaacgagtccctcgtggacccggatcgccgcaacgagtgctcgaatggcttgcatgtggctcgtcgtcagtacctgggcagcttcagcggcaacgtgtgtgtgctggccaaggtggccccggaagacgtgatcgccgtcccgtcctacgacgcgaacaagatgcgtgtccgcgcctaccacatcctcttcgaactgccggacgaagccatgcgtgcactgaaggccaaccgcagcatgaccgacatcaaggaagcttcccgcatgctgggggctgctctgtcgggtcagcacagcgaaccggcctaccatgtggagatcaccggtcatcggggctccagcatcgtagtgcacaagggtccggacagcaccaagagcaaggtgcagacggctgtaccgaagaacgctccccaggctcactcgctgccgactacccccggcgaagttgtgggtgagaaggtggatgttctggacgtggtggataccgtcatgacggaaaccaagaagccggaaccggaagccccttcgctgaccaaggacgtgccggtcgctgagccgaagcctgccaaggccgagaagaaatcgaagagccgtgtgcctgcccgtaaagccaagaagctgaagtccgtcaaggtggaagccaagcccgtggctcagcctatccgtgacaccttcaaggccaagggtgaacccctgccggctggtaagaagacttccatgaccctagccgaacaaggcaaggctctgtgggatgccttcgtagccagcaagggcgacaaggcgaaagctcaggcttgcctggacttcaagaaagccaagaagaagggctggaccgttctcggtatgcctggcgacgcggctgacaagttggccaaggcgctgaagtaataaaccagggggaggcaactccccctttcctttctcgcaggagttaccatggactactacttgttgtacctggctttgggtgccgcttggttcttcatagccatcggcgatgtctacaaggtgccgttcaacattgccttcagcaggcagttcacaccgtctatcatcgtctccctcagcttcttcctcaccttcttgttctacctgttcctgtggcctgttggtgtcatcgcaagcatttggctacggatgcgcaagaagtcaactacctgatggatacccgtgtgttccagtaaggattgctttatcatggcaactggctgctatacggccttgaactttgctggagagtaccaatgccttggaaaagcgaccctaacatctggggggtgctgagtgctatcgcgctcagtgtattgagtggggtgatcagcctcacttcaaggattgcaaagggacacccacctaaatttgtgtggattgtctcagagctatcctcagcgatcctcgtcggctatctgatctacgacgtgtatcccgtgatccaacatctgctctacgagtggatgaccatgccaatctgcattgcagttggtggccacctgggaggtcgagtcttccagtgggttgagttcaagtacaaggagaaattcggcatcccggactcctactaaaccaaccagaaacccgcttcggcgggttttttattgcctggaggaaaccatggctgaggtaatcactaccgttttggaaatgcccaacaccgtcattgcgacggctgtcggtgacaagatcatggaagctgacgcctaccgtcactacctggagtcaatcaacgttgatcctcggtttgtactagaagagtacatcgcaatggttgcggaaaaggatcaggaggtgtggaagcatgtctaagtacgaaccagtgttcgatagctctaaggtagcccggttctaccatgtgcgtggatttgctgagcgcaacggaaggcaggtcagattcttcaagactacctgggttggcttcctagaaactgaccgagcctactgggtagtagatgaagatgatctcaaggaactggagcatgtcgtacgcattcgtaagatcactgctgccagtgatatccgtgatctcgctaaggagagatacggtgcctttctcgccctgaaagacggtagtaccaagcgagcacgcacttctgtgaaagctgccttcttcagcatgatctgtcgtcgtgaacgccagctgtccattctggagcgtgatctcaatagtgcacagtcaatccttctgggtactcgcttggataccaaggtagccgagcgtcttgagatgctgaataccactacggtagagatccccagttcctgggatatcgaccagcagatcctggcagagcacaagcgtatccacgagaacgaaggacacgaagaaggtgcactggtctgggaacctgatttctgacaggcattaaaaaacccccgaagaccgcagtctaaggggggttacgcatggtgtcgaaggagactactggggaggagcgtgccccagtgacttcacaatagcgtagctcttctggcatgtcaatcctgccgcatggcttcggtcaagcgctcctgcgagttcttgtcgatggctgacacagcttccgtacaggtcggcgagcaccacagaggcagcgttacttgcatgccgctcagtggtagctctggcatcatcggcgatgaggtcgtcacgtagacgggagacttgctcccgcaggctacgagactgagcatcagcagcagcaatgcgggcagcttgatcagccagttgttcatcagcatctttttttacctcgttcatggcttcgagcagactctgttcgatggcctttttgttttcttccgcagccctttcggcctgcatcatgcggagttcccactccgcattggtcttggtttccgccttcacgaagcccttgttgtaggcatagagagcgatgatggcgaatagcagtacttccgcaatccaccggatctggcgggctgagatagtcattgggtcaccacccttaccgccttgcggtacagttccggccatgtggcttcatggggttgtccaggacgccactgtcgcaggtagagatcccacgcttcagcctgggccttgataggcggcagccggtgaggatccgtgtagagcaggatacgagccaaggcacaagccaagacatcatcatgctccagggcatcccacacagcgtcttgggtggcagggactcccctggccttgcacaccgagtggaccagttccttggtggctggcttccagaagttgagtagccccttgacggcaccacccttctccatctgccagtagcccttggccggtccgaggggaagaaggactttacgcccttcgctgttgatggagttcaccagctgtctgcgggaagcaaagcgggactcctgtaacccaatggccagcagcatgacgctggcctcgggactgttcatgctggccggaagcagcttgtaggcttccggcagcacctgattgaatacctgatccgcagtcatttcggttcctccggtagaggatagcgttcctggatttcctggactttctcaagccaaggagtcaggtcagctacctgcccttcctccatcgccttggcttccagttcgatccgaatcggttcgctctccgtctggtacgcctgtgcccgaaggttcttcacttccttcagggcttcctgatacttcgacattgccagatccttcgggttctggaagtcgttccaagcgatagaagtcaaagggcatctccacgggaccgtcctcggtcaccaaaaaaggttcaatgatcgactcttgagcatcgaagatctccagagtcacttgatgaatataccggatgaagaggtttccgtcttcatagcggatgtcctggaaaggagtacggcctacataggcttgcggagggaggtaacctcccccaatgaagggggagaagtcatgttcctcaccatccacagtgagcttggtgccggaaaccgccacctcactcactcgttcccgacccggtacatccacttgcatgtcaggcttgaggatgaatttcattatttccaccgtcctacggcaactaccgcgcaattgatgaatgaaccactggcaaagctatgtgcagtatacccagcaacacggtagatctgcacaagagcattgccgttcgccacgttgtaggtgaacggactggtcaccgcaaagtaaggcatttcgttgatgtccgcacgggtaccaaggatcggttgtaccgtcacggtagggggtgcaatgaagcccatcgggtaggtgtaggtgtactgcaacacgtccacagcagcgtagacgaggcggatcgttgcatagacgatctgagtcccgtcagcaaagcgtacagaccgacctacgttgaggttgttgttgccgttgttctggaacacagcagaggtcagtacgtcattggtgacggaaccctctagttggttcgaagccaagagacgcacccagctttcccaaccgttgttcgaccgagcacggtagaacacggaagttgcataagacccagcaccaccagtacgcggtaacaggaactggtacttcgtggcgttatcgaacaccgaggtgatcgccgtgtgaccgttggtgccatccatgtttagcggcaagccagcggtaccagtgggcaccgagtagaagccgttgctggctgcgttgtcgatgttgttgctgggcagagtctggtttgcgatgggcataccaccgatgtagttgagtgcaccacctgctgaagatgcacccagcaaagctacaccagtaggggtggtagaaaggttacgccagccaccatccgcactgtcctggatcggtacgaaaccggacagggtagggttaccaggcgggttgaacaacggcagttccatgaacttcagggttcgcggcttggtgacgttgttcgcatccagccaagtgaaggttgccagttctaccggggtctgccaaacacccgaagtattcgtcgtacggatgaacagacggccagtgtaggctgggttccacagctgccatcccttgttggtgtcgtaggacttgtggtccacgaaagccagagcagtgttcaagccagagggcagagggttacccgcaccagcaggaacgtggtagtagccgctacgcacaccagcagcagacagctgagcaccagtacggctatccatggtcagttcgccgtaaccgtaccggctggtccagtcttggatgaaggtgaccacgtactcggtgttggcgatggccttgccgaacggcaggaaaggagtctgcgtcgggacagtcggaatgccagtgaaggcagggctatccaacgaagcgaagccattggtatcactagagttggagaagaactgacccagcttggcagcgatcttctgagcagcggcatccgtcaggtgcaagccatccgcatcagccagggcagggtccatgtaaccgtccttggcgatgagtcgtgcgatgtccagggtctgagccaaaccattgaccttgggaagctcggtgctccaccactggtcggtgtagtcacgaagcttgaccgtattggtcgaggcatcgttgtacgccttggtgccctgcatggagttgaacaggactacctgggcaccgacagcatgaagctggtctacgatggcttgggtatccgatgtccgcttggcctgggtcatagtttcgtcattcacgtcatttgtgctggcgtgcatgaataccaccttgacaccggaaccactgatttcactcagttggctcagatactgccaggtacgacgaccttctacaccctgcacaagcacgaggttgttccggttggtggcgtagagcggaaccttgccgaaccaggtaccagcccagttgcggttgttgttgtaagggttgttcccacgggttaccccatactcgttctgaccagcagcgatgctatcgccgtagcagatgaggttgggcttgcacaccgagatgtagtccagatccaaccaccagttctgcggtgctacgggcatggatgagacttcgatgaaggccggcttgatagcgtcaaccataagacgaccaccacccttctgccaggtgccattgggcatgcggcggaagagttcgatgtggcggtttaccgcatcgtacttcacagcaaggtctagccagtcctcggttcccaaaccagtgaacatggttgcagctttgcgggtaccaccctcggtgccttgcatgtggatggtgttgggttccaccaagccattcgcattgacgttgaagtagaccacgcagtccttgttgtcagcagcgatgaagcggatctgtgcagaacggttctgcgaggcggtaccggtctgggtcttcacacgcatgtagacgatccagtggctgtccgggaaggtcactgcctgtcgcaggaaagcacgagagccactgccatcggtcttggtcagacgcatgacgttgccgtccgagacagccgtagcagggccagatacagtccatcggtaggggtcagtaccttcgtaggtaaaggtttcgttcatgcctacgagaggcggaagggaaccaccctcgaccatttcagccataccatcggccagatcccgagcacggtcagcctcgctcttggagcggtcggcttccgtattggaacgatcagcctgggacttggcttgagtgacagaggtagccgcagcagtagcttgagtggtggcacgatcagcttcttccttggagcggtcagcctgagcggtagccttggtgacttctgccttggccaaaccaacctgctcagctgctttggtcacctcggctttggcgaggtccacttggtcagctgctttggcgacttctgccttagcaaggtccacttgatccttcgccagttccacttgctcagcagccagacctacctgagcctctgcacgatcagccgactcttccgcatcatctcgtgcattgcgagcatcgaccaccgcttgggtgatcttgttcatggcttcctcgtcccacggcagattcgtgggcgggggcatcaggatcagttcctgcacgtagaccggatcagaagagtccggcacgtagaaggtgaaggtgtactgcgagcagggatcgtcctcgtactcgtcgtcatcgcctacagcagtgacgcggtaggcagaggtagacgattccaagtccatggtgaactcgcccttggcgtcggtcaccatctcgtaggtttcgggaattacgacgcagtgctctgcatcgctcatgccaggacgggtcagtcgcacggtgaacttctcgttcgcctgcgggctgccatccgggttatggaaggtgaagatcaccttggtagtcatggttgtatcctcttcgaagggagcgtgcagtgtaccgtttattcgatggccaacaaaggatggtcaatagtgtaaccgggctttttgccgctgatgaaagcagcgatgtacatccaacccgtagggccgttaagcattccaatggtgaaaccattgtgcctgaaggttgtgttaccgaagtccactcggaagtaggcaccctgcttgattttggttgcatcggcataccaactccccagtgtacgaccaccagggaagttagggttgtagccgtagggtaagaacctctggataccaccaaggaatactgctggtgtgtagccagtatcgaatacgccattaccatcagcgtcaaatacttgcataccccagccagcagtctttggcatatgcacagcaacgatcttgtacttaccggaatacaccgaaggagccataccagcaaagttggtcagtacaaagcgacaaccggtccagttaccgttagaaccgaaccaagtgaagtccatgaaaccatgagggccatcttgcttagcgaagaaaattggcaagctctgggatctgataggggtagggaactgcacgtagataaagccttgcctaggtctgtcatacttataggttccttcgaacacaacaacatagacgggattcaactcgtcgatgcagatgtcactgttttcgtttgtcagtttaataccgtaagtcatcggaagctcaccacgttgagataggctttgccatatctagtagagtaagtgtcgtaccactggatctggttattgacgaaaccaaagtctacaaactgaggccatgggttaggtgctagttgaaaccaagtaaagaagaagatgtcccccttacttgcatcaaaaccagggggcaaattagtagtgccccctaggacaggaaacacctgttgcctgtacacagacctgaaggacttgttggttgagtcaacggtgacgttaccgttggcgtcgtaaaagcggaatccgtaactcatgcttgtaggttcccaatgtgcacccggagtttgcctgcttggtcaaacaccttgatggtggcgttgttgatagtcatacggccagtgcctgccgtaccgttgatttccatgatcccgttgggacggaatgcccagccttggacacctggttggtagttgtccgactggatgttgttcaccacgatatccttggcttcgatgtagtcagcctggatcttaccgttctgaacaatgaagctaccatcctgtgccctgagcttgtcgaaggtcaacttctggatggcagcttccttgatgtagacgatattgttgtcgatgatgaacgggtagctgcctgggttcttcggagtaccaggacgaccgatccagaagcggtctacgttgaagccggcttcgacagtacggccatcattgtagacaccgaagccaccaaccaaaccattcacatcaacagtcgcagtccagcgagcaccgatctgggtaaccttgccgtccagagtctgtacctcagcaaccaagccaaccttaccagaggccgagtcaccattgaccgtggcgtttatcgtggtaaccgaagaagccaaggcattaaccttggttgccagtgcagtgttctcctgctggattgctgcgatgttcccattgaagtcggcgtacatggtgttgaccgtctgaaccagagaactgtcagcagttacacgagcacgaacctcttcctgcaagatggcagtattctgatccatcttcgcatcgatctgagtgagacgaacaccgagagcatcatcgttcttggctcgttcaatctcttcctgggtgatccccagcttgttcagttcgatctgagcaatctctttcctcaactcttgggaaagaagaccactgtcaatctcaccagtaagctgctcaatcatctgctcaatgagtggacgagcagtagccgaagctggaccaatgatgtccccatcagtgccattgatcgaaaccaactgaatccagtagtagtagcgttgatctactttggagccagggtctgtcttgtcgaagtagaagttaccgttgacgaaggcacggatagttgcaccagcgaagttcgcatcagtgctacggaacagtcgagtagtacctactgctcctgggtttgtggtcggccaagtgaactcaatgtcgatacccccgaaagcaggagttgccttcagcagtaggtcattcatgttggggtcaccgggcttaggaccattccagtccccagttccgcagaccccattgatgttgcaagtgtcaaccatgttgattcctccagagttggtcaaagtataacctccctaacctcccccagcctatccacgcaggaacgcagtccgccgaggatcgagcgtagcgagcaccgcagagcgagacgggagtggatgcgtggataggcggaaggaaataattgaatattcaatttcttccggtcagggatcaggttacgggtcatcccttgcgggcctcgctgcgctcgctcctcgggcgaccacttcacctgatcccttccctgaatggagaagggggagggtgagcgctagtggtcgccctgggacggccccttccaggggcgaaccccttcgaaagaagaggggtgagagtcccctattatatataagacactttcgcgatcattttttaaccaggagaattccgtgaagaaaatcatcgctggagacatcccccacaaggatttccccatcgactccatgcccactctcctggcccatctaggcaaggctcgggctgacaccatcaggttccatggtttggaccgaaggtctatcggcggtcctagaacacgctggtttagcaacccccacgcaaaacgcctacaggggcttcctgatgcgttttcggatcgaggggtagaggacatcctctcaggcatcgcatcggccacagaaggctcccagaggccgctatcggctgcacgtctgttcgtcctgctacaagaacctcagctgtgctacgacctgctcatgggtggcatggctttggagaagcgacaagcgcttcgctacatggcagcagccaagctagccgtgttccacctcaaccgatactttggagcaagcaatgagtgatttcctcgactcaccccatcccgtgtgcaatgcacagcatccgcagggacagccttgtgtggactgcaagaaactgcaccacatgatgcccgtcaaggcttctgtgaaagcacctgccgatcagcgggcggaagcaaccacgaaccgctatcagagaatgatccctagcaactggaagttcctggacgtgtaccggatcaacatgctgttccccctgggcgacatcgaccattccggtgccctggaccatgcccgcaagaagctcatggcaccaggccaacgtagcggcggcaagagcctttggcaagacgtgaaagaagccagggataccctaaatcgttggcttgaagacaacgtaggagaggacgactgacatgggtcagatctacaccaaccagacgggtattccgatggccatggctttgtggctggcttcggactactacgactacagcgaagcaggactgtcagccaccaccctgctgaaaccaatcaggcaggttgtgctggctcgacggatcaagccatccgactccatggccgatatcgagggcatgatcgccaaccgcatgggagcggcgattcacgactccatcgagaaggcttggaccgtgaacaaggatcgggcactggatgccctgggcatccctgcaagcgtcgctaaacgtgtgctggtgaatcccaccgaggcggaactcaaggcgttcaacgaagccaacgagcagcctgctatcaccgtctacatggagcagcggtccaagaaggagtacgcgggagtaatggtatccggcaagtacgacttcgtggcagacggccaggtggaagacttcaagtccaccaccaccttcagctacatcaaggactcgaaggacagcgactacatcctgcaagggtcgatctaccgtgctctcaatcctgggctgatcaccaaggacaccatgcgaatccacttcatcttcacggattggcagaagttcatggcgaagcagaacaaggactaccctcagagtcgtgtggcttcgaaggtattcaacctggtgcccatcgccgagacggaagagtggatcaccaacagggtgaagtggctgatgtcactgaaggatacccctgaagcggatctgcccctgtgcagcgacgaagagctatggcgtagccagccggtgtacaagtactatcgtgaccccgccaaggctgaccagaagggtgctcgcagcaccaagaacttcgacagcctgtcggaagccatggctcaccgtgccaaggatgggaacgttggcgtagtgaagaccatccctggccaagtgaaagcctgcctctactgcccggcatacctactgtgtacgcagaaggacatgctcatcgccaagggcgacctcatcgtataaacctggagtaagtgatgctcacgtacgaggaaatgcaacaccacccgacctcggaacgcatcgtcgaaattctgtgcgagaagacccaatccaagaatcacaggttcttcaggatcttggttggcttccagttctcgatgatggcagcgcacatgcgttgccacatcaagacgcacgaacgcggcgagattccggtcaacatgtacgccctcaacctgatgccttctggtgcaggtaagggcttctccacgaaggtgatggaggaccagattacctatggcttccgccatcggttcatggaaaccttcgacaccgcagccgagaaacacctcgacgatctggcgttcaagcgccacatccgcaaggggtctgaattgcccgacgaacaggaagctgtccgtaaggagttcaagtctctcggccccctgctgtacgacttcgactcgggtactggcccagccgtcaagcagatgcgtcacaagctgctgatggccaacgctggtgcagtcaacctcgtcgtcgatgagattggcttgaacctgcctgccatgaccgagatcatgccgacgttcctggaactgttcgacgtgggttcggtcaagcagaagctggtcaagaacaccaacgacaaccttcgcggcgaagagatcatcggtcgaacgcccaccaacctcatggctttcggtacccccggcaagctgctggatggcggcaagaccgaggaccagctgatggagttgctggagactggctacgctcgtcgttgcttcttcggcatggctggcgaaggcaagaaggtggacatgaccccggaagaggtctatgacctcatgacgaagaactccacctccaccttcatcgaagatctctgcgatgacctggaacgtctggcagacgcaagcaatatgcgtcgagtgctcaccatggacaaggacaccgctctgctgtccatcgagtacaagctgaagtgcgagaagatcgcagcaggcttgccggagcaccaggaagccaagaaagcagaagtgacgcaccggtacttcaaggctctcaagctggcaggtgcctatgctttcgtggacgactcgccggtactcaccatggatcacctctacgcagccatcaaggttgccgaggaatctggcgagtgcttcgacatgctcatgaccagggaccgtccctacgtgaagctggcgaagtacctggcagcgaccaactcggaaaccaccgtggccgaactggatgaagatctcccgttctaccgtggctcccgtcagcagaaagacgacatgctggtcatggctactgcctggggctacaagaacaacatcatcatcaagaagacctacgagcaggacatcatgttcctccgtggggaagcactccaagccaccgacatccatgacaagagcatgatcgtggcctactcgcaggacatcgcgtacggctacttcaacgatctagcgacttgggatgacctatggaagatgacccaagccaatggtatccactggatcaaccaccacctcaatggtggagaagagcgaaagggtcaccgcaatgaagagaactgccgggttggtttcaacctgctggtgatcgacattgaccatgggtgcaagctgtccacggccaaggaattcctgaagggctacaaggctcttctgtacaccacgaaacgccatcagacggacggtaacggtgatcgcttccgcatcatcctgccgctgaactacaccctgaagatggacgccaaggagtacaaggagttctacaacgccgtcatcgagtccctgcctttcgaggtggacgatggtgtcggtcagcgtgctcgtaagtggctgtctcatgccggtcactacgagtacctggatggtgagttgttcgacgcactgcccttcattccgaagaccaccaaggatgaagagcgtcgccggaacctaaaggatcaagcgtccatggacaagctggagcgttgggtaatcaacaacaccggcgacggcaacaggaacaacatgttgctccgttacgcaatgatccttctggatgctggcttcagcgtcaatgcaatccacggcaaggtgaacgaactcaactcgaagatggctgacaagctgtcggagatcgagatcgcttccaccatcatggtctctgtagccaagaaagctggggccaacggcaactgagcttaggggtgcctccggcacccttttgcttacaacatggagtcaatcatgacgcaagtgaacgaccatctggtcttggtttccggtctgtccgctactggcaagtctgcctgtctgcggaatctccgggagccggagaaggtcatctacctgaactgcgaggccggtaagcggctgccgttcaagtcccgcttcatcgagcggacggtgaccgatccctaccagatccccaccgtcttcgacgcagtggtggaagggaaggtagaggcccacacaatcatcatcgacaccctcacctatctgctggacatgtacgagtcccagtacatctaccgggctgccaacgggcaggctgcatggatggatttccagcagttcttcaaggatctgatgcaacagaaggttgccagcagtccctgcaaggtgatcttcctggctcacaccaaggaagagtacaacaaggcaaccatggccatggacgtgtgcgttccggtcaagggtgccctgaagaacaacggcatcgaatcctacttctccacggtgatctccaccaagaaggtggagcttgggaagctggagccgttcaaggagaacaacaagctcttggagatcacgccgcaggaggaaatgcttggctacaagcacgtcttccagacgcagatcaccaaggaaactgtcggtgaacgtattcgtggtcccatgggtatgtggactcacgagcagacctacatcgacaacgacatccagaaggttctcgaccatctggactggtactacaactgattcacgcatcgaaaggaaacagcactatgttcggtaacctcagcaccagcaacaacagcgacatcaaggaagccaaggacagcatcggcggcggcagtcgtatcttcgacaccgacatctatgccttcaagatcctggccgcttatggctccgaatcctccggtggtgccctggcagtgaacttcgagttcgaagagcacggcaccggtcgcaagctgaagattcagcagtacgtgaccagcagcaaggaaaaaggccagaacaactactacgtgaacgccgaaggcgagaagcactatctaccgggcttcaacatcgtcaacgccatctgcctcatgaccgccgaaaaagaactggcggcctgtgtgccggaacagcgcaccctgaagatctacgacttcgacgccaaggccgaagtacccaagcaggttccggtcctcgccgacctgaccggtaaggacatctacctggccctggagaagatcatcgagaacaagcgcgtcaagaacgaagccaccggccagtacgaagattcgtcggaaacccgcgaatccaacgacgtggcggcagtcttccacttcggcaccaagaagaccctgaacgaagcccgtgccaaggctgaacccgagttcttcgacaagtggaaagaagccaaggccggtaccgtccgcgacaagaccaagaagggtgctggcggcggtgcagcctctggtcgtcctgcaccggctggaggccaagcaggcggcggtaagcccgcaagcctgttcagctaagccatgaaggtccgggaactgctcgattcgttgaagcggcagttgagctactgcacgaacccgcaacaacgcgaacggttgctggaccacaccttacgcatccctgtcctccgccccggaactgtcggggcgaggccatctgtggatgtgctgagtgtggttcctggcttcgattgggatgatggttcgatgttctgtgaacccaattccgacatcaagctgaccgtactgacccctgaagaagtgaagaccatcatggcgagctacagcaaggggacatcttggtttgcctaccaggaaaccaagaagctacgggaagaaatcaaccggctgaagaaacagctggagctactcggaggtagcgaatgaaagtcaacccgcaagacgtgaagaacatgatcgtggaagagtctttcacgatccttcccaacggactgaccaccgtatgccagcttaccttggtcaacggttggacggtcaccggtcaatcagcctgtgtggaccccatcgaattcgatgctgagatcggcaaagaagtcgctcgtcgtaacgctgaagacgaggtgtggaagttcgccggctacgaactcatgcagaagctgcacaagctgaagatgggtccgaaggagcggctgaaactggaactccaggagcttcgtgagcggcaagagcggttgttcaatctgctgcatacggatgctgctgtggacatcccggagtacgcctacagcctcctggaacagcaggaaactgcccagagtaacctcatcgacatcctcgaagagcgactgaagcaatggcgcgactgaacgtgatcggcatggaccccagcatgagcaactggggtcttgcctgcggtcagtacgacacaacctccaactccctcagcctacggcatatcgaagtcatcaagacttccaagaccaaggacaagcagattcgcgtcaacagcgatgacttgaaccggtccaccgagatcactaccagggttatggaggtgatcaaggaagccaacgtaatcttcgtggaagtgcctgtaggatcccagtctgccgcagccatgaaaagctacggcatgtgcattgggatcctctctgccgtgcgagcaagcggcaagcccttccacctgctcaccccaactgacctgaaggttatggcttgtaattcgaagaccgcttcgaaggaggccatgatcgaatgggcagtcaagaaatacccccatctcaactggccacgcacctcgaaaggggaagtgatcgccagccggtctgaacacatggctgatgcctgtgcagcagctgagtatggggtcttccatcacaatgatttcaagctggccctggccatgctcacttaaaaggaaccaagatgaaaatcgaactgcaacaagccgaagtcgccgctggcatcgctacctacctgaccgccaacggcctgaaagccgacgcctcccagctgtcgatctccttccaaaccactcgcaagggcgacggcggcatcgtggctttcgtcgaagtaccggaactggccgtagccagcctggtcggcaccaaggcaccggtcgctaccgaaccgcaggccgtggaagtcgtcgagaagccgaagaaggccgagaagaaagtcgttaacaccgaagcggccgccggcctggcaactgccgttgccgaatccaaggcaagcgaagcagcgccggtcgaagtagccaccgaagagccggaaccggctaccgaggtggaagccaaggaagaagagccggcagccgaacaagcagccccggccagcaccggtggtagcctcttcagctaacacctcttccaggccgatagcccccgtaacagggggctgtctctaccggagtaaaccatgaaagccaagtcgtattacctcctggccttcgctgcacccacaggcgtaggtaccgtattccagtcagccatccatgctttcgagcagggcaagagccacgacttcaccgtacccctcatcgctcagatcaaggagcgtagcagtattagtgccaactcgatcatgctcagtgtctccttcctgggtaccatgaccgaagcagagttcaatcccccattccgtcctggaatggatgccaccgttgcatacctcgaaggtgtgcgtgctggcttggagaactccgagaaggacaacccgtaccccactggttcggtcgaagcagcggactaccgtaatggtcggatctctggcttcagcatgcgtgaaggccaacagcctccgcaggatcacagtccacagtaaaaagagcattcccttttgtccgctgatacgtcactaccttcattccttttctgaagttctcgtaatggttacgggtaggcggactctttttagtgttgactgccatgtcagcctcctgtaagttgagaaccatgaagtggagacaacctcttaccacctcatcggcccctggataccactaccaagtccctcttgtacccctagatccaaggggccgtttaccacctcccttaactgatgccactgtagaccaagccagctaccccagctggctttcttatgtctattgaaccagtaggcataagggagtgctctggcccgttgcaacgggtacacccaccaccccgcaatggggtccagaccagagcactccatcccttacacccaaccagaaggaacttcgctatgggcgatttgagcaaagcgtgcatgctgaaaaacatgcatgtcacccgtgtgctatccctcatcgaaatgcgcaacaagctgacgaacaccctccgggacaatgccaccgacgacggtatggctaccctggaaatgttcgacgctgccctgaagcaggaaaccgaccgcttcctccgcgctttccgtgcggtaggcaacgagaacatcaacgagatcaagaaggcggccgaatgagcttggtagatgcggtagtagaagccaagcgccagggcgtacagcacagccttcgtggcagcaactacgagtcggacatccctccgagcctgaaggctctcctggatgaagcactgcgtctggccaacgagcacagcatcccgctgtactggtctgccagtctgccgaacggtgtgatgactcgtgcagcactcggcgagaagggtgagaacatccacatccagtacctcatgtcctacgcggctgcggtacaggatcctgcccttgcacaggaagttgtgcagaaaggtatggccttcctcgacaagcagtaaggagtccacatgggagtcctgaaaggattgttcggggctggggcattagcaggagccgtgattggcattctattcattggcttcgtattcagctggatcttcagaatactcggcgtggtagtagcactgttcatcgtgctacttatcctgtgctgggtaggctgggaatggctgaagtattgcttcagcaaaaagaaggagggggagcaatagctccccctttcttcattacaggttcataagacctttgatgcctggaagttcgctcaagctggatggccaagcccacggaccagactggaacgggttgtgcccgatccggttgatccaagagctatccattaccgactgcaagccactcacaaagtagttggcagcaaccagagccagtgcacgagcaggcttctgacggattaagcgagcgatcaccttctgcacacgcagatagtacttggtgaacatcaccagacccatgtcgttcatgaactgaagaccacggccagaaggcaagtcgtagttgatgaacgattcttcagcctgacgcagtgcatcagctttactcagcggatccttcgcacgagtagtcaggtgctcatacagagcgtaacgagcaaccaggtcactcagctgagtggtttggctcaagaacttgtacacagcagtgtcgtgggtcatgtagacctgacggccaatgtcccggaccaacttcggcagcttgctggtgtacttctcagtcttcttctggagcaaagacttgtagctgtactgcgagtcatcagcttccacatcttctacgatggtgggcatcagtccagcatctaccagcggcttgatcgggttgcgattcaggcgatccatcagcacagcgatctcatcacgaacagcttgctcaccggagggcagataaccaacgtcgagtgcacgctgaagctggataagcttcttgttgtcctgacgatactggagagcagccttgatgccggtagcatgagcacgtacaccctcagtcaagccaacaccttcccaagccaacagagtcatgttcgacacaatgttgcctactagagtggtgatgttcttgattaccaggatgtccttggcttcacggaccagttcctgcatcacatcctcagcacgaccaatgcgaagtgcagctttctctcccaggatggcttcagcaactcgtacaagtaccttctcggcaatgttgcgttcgtcttctgccaaaccaaacggagtagtcagactgtacttgcggtaacccatgatcatgttcagctgatcagcagggatctgcatgttgtcgctaccccaagtcttacggatctcacgtttagtgctctccggcagcagttggtacaactcaagcagttgcggatcagtgctgtccttgcctactaccaggtagctgctgggacggttggcgtaatcctcgcggaactggtcgtacatagcacgaacaacgtcagcgttctggattgcggagtcaaccttgtccacgatctgacctgcaagagtaccaagcacctgttccatggagttatcacgatccagcagactgtcacggttgtgctcagtcatggtatagcggtagtccacgatggctccattcgggttcaccacaggagacactcggccaggtttctgctggcgaggatcgtaggaacgatcacgcaggaacatgtcactcacatcctgtgcaatgttgcgcttgatggtagtgatagcgttcttcgcagttcccggagcggacgacagcatgttggtagcctgccgatcaactttggtaccacgagcatgcacaccggtgtagctcatcgcaccagtcagcaagccaacctgaccactaccacgacgggtcaccagaaccttgtcggattccagaccagcacgttggtctacctgcacgtcaccagcaacagcgtagccacgcttctggaagtagggcaggtcactgcggtctacggccagcacttcgatcttggagtcgaagatgtccggtacataaccatcggtgtacagacgctcggtgccttggaacagggcatccttggagcgcttacccaagccatggtgcatagccaggatcagatccacaccgttgccatcggtacggttggattcggtcttcagcacttcacgggcacggctcttcacctgggaaccagagtactcccacccatagacagcttgcagctggtccagcagttcgatggctttcgcacgatctgccttggaggactggagcacacgcttggtaccaagcatgtctgcgatgttcgcactgttcagcatcaggttcgggcttacgttgccaccaatcacacggtggtaagccagatccttcacagcacccaggaaatactgaccgttcggcaatgccagcagttggtcttcgaggtctttgcggagattggcgaactcgccattgtccagaaggacttccttcaaccgatccatacccagagcttcacgcaggttgcccatgttggtacgcaggaaacctttggtcagtgcagcacggtcttcagtgctcaggtactggccattgtccttgaagccttcattgatcatcgcagcggtgtactcgatgtgttgcttacgagccatctcgttggacttggcttgcttgaacagagtgtgtgcagcgaggttaccatcgtgtgcaccacgcatctcgttcactacctgcatagccatgccgtgctggctcttgaaagcgttgtcacggatgcgagtgataccgtccaggaccaagccaacacgctcattggtgatggtgctgatggtcttgccagctacccgaacgaaggggctgtccgactgagtgaagaaggtcgattcagcgatacggttcaggttgtccttgatggcttccccggtgtttgccaaggcagtttccacctggtccagggcacccactttctggtcagccagacgtccacgacgcttggcttcgatgtccaccagacgatccaccagagtgaacaggcggctctcagccacttcacctggacgggtcttgtcgtgcagctgacccagacgggtaagcaggcgacggaacatctccaccagacgagtagccagtggcataccagccaaggacttctcgctgctacgggtagtgaactgaagcaggttcgctacttcttggctcgctacacccagggcagcaaagcggctcaggtagtcactgcgggaaccaacacgctcaggacggaacaggaagttgtacttctcctgtgccacatccttctctgcctgagtggcttggtcccactcaccagcgaagaagtccttcgcagtcaggcgatccttggcttcacgccataggttctccaggctgctgcggatgaatattccatcgttgctgttcagagtggtggccacagtagcctcaacctgctccagcacgtaggcttcctgcgggctgacaatgaacgccgaagccaatgcctgagaggcgaagggcaggcggccagtgtccagagccttcaggacggcatcagtggtggtaagtgcttggccacgggcaacctcgttgcggaatgcacccatggggccgtaaagctcggtgacgatgctgttcaggacagacttcagcttgttgctgtgagcctcggtaagcggggtcttctcgctttccagggcattgaagatctgctcactgctcatggcattgacctgatctacagcgtcctcgtacttcagggtcaggtcgctacgcttggccatctgtgcagcagcctcggcgaacaagccagaggtattgctgatcaccaaagccatggcattggtatcggacggcttggtgtcacggaacagcagggcagtcaggttacgaatgaaccgcagcagcccgtcagtgaaaccagcatcacgcttaccagcaggcatctccagcttcttcaggacttcttcctggaagccctggttggtcatgccccagctaacaagctcatgcacgttcgacacagcgttggcgtacttggcagacagaccaccgttcttgctcagcatgtcgctggcacgagagcggatcatctccaggtcgttgaccatacgccagggcatagagtcgtagttggagttggcttgcttcttgtccaattcacgctgaatggtacggcccaggctcacatggagcagttcgtgggtcagcatctcttcggtgatgcccgactcgacgaactcaggactcttcacgtagagagcctcgaagttgccctgggttgcataccagccacgagccttgctcacaccctcaccgatggcaccgtcagggccagtggtagaggtgatcagcttgaccggtacatcttcacggatggaccgcagagcagcacgcagcacctgcttgcggaatgggtcattggtgcgagctaccagagcctcagccagaccacgagtggtcaggtcattggtttcggtaagtagatccaccagtgcttggtcagacggagttaccggctggcccagttcaccccataccgaggtcttggtacggctgttctgttgaacggcctggaccacctcagcagcacgatcttccggtaggacttccttggcagattccaagctcaggttggacttctccatcacctgggctacctgcttgatgtcctgttgcagctgaccttcagccttgatgcggtccatggtgttcagcgtagtagccggagccagggactgtaccgagtcattgcgcagaggcttacgagcagcaggcttggcttcacgcggagtagccttcagctgagcgtcgatagcatcagccatcgtttccgcttcagggttgaaggtgctaccgatctcttcgcgggccttcacagcagcagcacggtcagcatcggtgacgatgtagctaccgccatcggtggcgtactgacccactgcacgcatgttggccagcatgttcagcttgtcggtgtcagcctgttcagcaacgtgacggatgctggccagctgagtggagacggtagtcttctggctttccaggtacttgccgaactggtttgcaacctgcggatcctgtacccacttactgaagccagcaagggtacgttcgaaggtcgaaaccatctcactggctgccgagtagttcagcatcagcttgaaggtctgctcgttcaaacgttggccagcagcgtccatacccagtacacccacaccgtgagcatcgtggatgttcaggacatcttcacccatcagtgcattgtgggagatgaacgagtcacctgcgtgggtagcagtgatgaacggagctacacccggaccttcgttgacggtggtcatgccactggcacggaagctcttcacggactgcttgcggccttcctcatcggtgaactccagaggttcagcgaagtggacttccgagcggtacaggggagagtcgttcagttcacgacgagtcttcgccatcagcatccccgaatccaggtcaccactggctttcgagaaagcggtgtgcaggatcggttccatgtctttcaactcgttgcggatctgttcgatctgagcacgagtgagatcagcgaagggctggccatcattgccacgaggcaggttggccgaagccagtagctcatcacggcgagcctggaagacagcttcgtacatctggaaagccatgttcgcagtcttgttgatggtgtcacggcgagcgatgaagacctcgtaggcatcgttcagtgcactctctaccttgctacccagcaggtcatagaaggcagccttgatggcggtctgctggaccggggagtagacagtattcagtgcttgctcgaagcccatgtcggtagcccacagctgacgcttgtcgctgttcttcgaaccaatgaggctgttcacggcagcgatcaccttggacagggcagcttggtcaccagcattggcagcgtcttccatcttggagtagatggtttcgatgaaggcatcagccataccgctgacagcagtcttggtgttggaaccaaacatcattgcggtcagtggcttcttgatgacattacgacccttggacgatacaccgccttcctcgttggtcagcacaccagtgatgacttccacagaggacagcagcgggtcattgcccagacggtccagcacagccttgatggtgccctcgtacaagtccaggttgccctgtgccttgtagtcgttgaactgggtgtacggatcttccaggctgaagaaaccaccctggttcaaggtgtcgaagcccttggcaccggacatcagcagggacagcataggaccgttggtcacaccgtccacttcgccgagcagctgggtagtgaaggactcagcaccgttctcacgggcaatcttctcttgagccagtgctaccaagccatccaagctgaagaacttctcaccagcttcggctacggctgccaggattgcagactcgttggccacagtgtcttgggcctcgccacggaggatctcagccagggcagatacaccggcctggattgccggtgtgttcaccttactgtcgtacttggccagcactttcgaagtgttgttgccctcggtcttcacaccaaaggactccagtacgcgaagcttgaagctatccatctctgccttgttggacagattaatggtgttctcccagccttccattgccagcatgtggcgatgcactttgctggtctgtgggttgatcatgttggcagtcaaaccaacacgctgaggcttccacacgctccggtcgaagtacagcggctgttccaagccaaggtcagaaacctcctggatcctaccgaagaactcgttgaagttgtcgatctggcgtaccagtccatcgttcttggcttgggtgccagcacggttggccttgtgtacgaaaccaccttcaacatctacagcaccagcgatggtggccaatgcgttctcggacaggttgccccagacttggaacatgtcctgacggagacgcataggacgcttgcttgcatcgtccaggatcttggccagttccttgggtaccggctgctgagtacgcttggcgttcttctgggtgaagggaaccggagtgaagctcggttcagtctgaccttcagtcgaaccgaacagcttggccaggatggactggcttccggtattggcttcacggatctggcgagcaactgcaccaggaaccagcttaccgtctacacgctcactgaccggggtcaggaagtagtgcttgacgcgggggttggccggttcattggagtccatcagggacttcagcttggcgtcgctgacagtggtgatctttgccacacccatcttcaccagcagagccaaggcatgctcacccagggaagcttccagacgagcacgctcgttcacaggagcattcggcaggacttccaaaccaaggacatcaacgatcttggcacccagctgggaagctgcggtggcctgtcgagtacctacgttgcccaggactgcataggcagcaggggagacttcatcatcggagtccttgcccaggatggcattgataccggcatcggtgttgaccaggttgttggccgcatcgatagcccaatcgtaggcaccgtaggcaatggcagtggtcaggttctcatccagagtaccgtcagcgttcaccaggaactgagcatagtcccggaagtagtaacggctggcgtcactggtcttcgaggtgtatggcttcagcgtacgctcgatgatcggcttggcagcacgttggaacttcatgaactgcttgatggcagactgctgctggccagtgaagctcttcacaccagcgaactcagccatgcggccttcaccagtgcggatcttggtagcgaagtctttgactgctaccagaggcttctgagtgtcaccgtcattgcgagccggggactgctggaagaaggcagaaaccagattggtagtctggtagttctcggcagcaacttcctgaccacgcacagcttcaccctctcggacagccgtgagttcaccagtttcggcctcggtagaaggttctgcctggatcgactcggtttcactgactgggacatctttagtgacctgagcgataggcgcctctaccggggccacctcttcagctacctgtacgggcgcttcctgtgcgggggcagcttcttgcaccacaggggccggacgagcaataggaccagccttgaccagttcacccagggactcagccgagcgagacagtgcagtggcttccagtgctacagcatcacgcagcttgaaggagcgagcggagatctccagaccaccagccgacttcagttggcgggcagtcatggactccggtgcttcggtccagttgccagcttcatcacgtacgatacggatggagttgtcggtacccttgacctgctgatacgcagcgtcgatggcattgaacttcgccacacgactgtcagcgaaggcacgcagttggtctacctgaccagcagccgcttcttcgttgccgttcatcagagccatacgcacagcgttgcggtactgaggcagacctttgaagccatcaccaccagactcgatgtcagtgcgtacaccgctcagacccttgagttcgttgagtgcaacctgtgcttcgctgaagctacgcagggatgcacgctgctcagcggtaagggtgttgctggtgtcagctaccagagcatctacttgctccaggctcagagcatccgggttgatcatggtcagggtgaccagacgctcggaggcttccggctggacagcagcttcctgaaccagagtctctacctcggcagccttcggagcggcttccacttggaaacgcttgatggcgtcacgagtagcggtcagtacctgctgagcatccttcagttccttggcttgagcctgacgctgctcaggagtgatgttgcggatctgctcacgtacgccgctcaggttggccagttcttcgtccaggcgggcaacggtagcttcatcagcaccctgcttggcctgctcacgttgttcgatggcttgctctaccttggccagaccttcttcactgaacaggacttgttcctgctccagctgggatacacgctgggcagcttcctgctcgatggtgtcagcctgctccagggcacggtccttgacctcttgggtcacaccatcagccatgacttgttcctggagaactaccactgcaccagcagggttataggactccgaggtcacatcggtcagggcagagatgtcgccggtttcacgggcagcattcacagcttcacgcgaagccaaagcagcctcagcacgggtaacaccagagcgggcacctacagcagcacggccaccgatgttcatggttccgccgacagcagcaccaatggttgcagcttcgacgatctcttccaggctggtgtctttcaggtgagcaacgttctcaccccaggtttggtaaccctcggtcacgccttcacgagcgctggaaccaagagtagagcggatcaaaccaccaccttcaccacggataccacgcaggatgccagcattggctacctgctcagctactgccagggaagcagcagcaaggcccatcttcagacgatcgtcagcatccggcagttggccttggttctcggcctggtactcggtgatgccttcacggtattcatccgaggcgtagcccacgttggtagcagtacccagcacagggttagcggcgtaggccagaatctgcggagcgttctccacagtgtactcgccgactgccagcgggttggttgccgatgcaccgatagcggtagcagcggtctggccgacaccgagtgcaccttgcaccaagccatccagaatctcgccacggctgaaggactcgcctgcattgcggagacgttctactccaccaacagtcgcatcagcgatgtcgtcgctcagttggtcacggcgagtagtgtctacgatgctcgaccagtcgaagaacttgtccacgtttgtagaaaacttgcggagttcatccacaccttgcatacgttgcagcatggtctggggaacaccgtcgtcaccggcagcagtctggctcaggatggcttcatcgccttcctgcatctggccggagacgtagcggttgtaggcttcgatggcttcgttggttacaccagcctggcccatgtcagcagcagcgttgatcggcagagcaatcacgtcgcctagagcacggccagtaccggatacgaaggaagcagcagtgttgaggatctcagtgccagcagcaccgggggtgatacccatcttgccgatgagggattcttccacgttgcgcttcttgcgctcgcggatgccgtcgaggtcgtaagccttctgcgaacccttcatgtccaggcccacactggcaaagtccagagcgtcgaatgccggggtagccccggcattcgcctcttgacgatccgacaggaattgatccaagtcgaaatcagccatctatcgtttcctccctcgtagtgcaaaagttagatcatcggttgggtccatggtaacacccttttcccgttctgccgagcgagttaccttaacggcatttgaccgtttttggttggcaatgtccgacacggttttcaggaagttttcccgaatggtaggagcgtcttctcgcatctgagtcatgccatcagtggtcatgagttcgatgatccgtttctccacgtcaccggcattcttgaatacccaggtgttcgtggtgttgaacgcctgctccaacagcttcgaggggactacagcagtacgcccgtccggcagtttgatgccgttggtggcgaagtccacaagcatgttgttcagatcctggcggtcaccttcccatccgaaaccagacttcacagccttgtcgatgatcttgttgaccgaacctaggggatctttgtcaggctcgacaaacgggttacgtgcaacttcccgttcgtagtcttccgtggcagtgcgttgcagagtatccaactcagcgttgaccgcaccgatggttgcctcgaccttcgcacggtcttgcggagccaacccctccagggattcccggagttccatctcctgcttggcttgagcgatacccttcgaactcacaccagcatcgacaagatccttgaggattgcattacgccgttcagtcggggaagtgttggcttgcacaccagcttcattcagcgcattgctgaaggcatccagctgatcctgggatgctcggctcatgtccggcatgccctggtcatcggtgggcataccaacttccttcccgacaatacgcatgatctcgctctgtgcttgacgcgattcatcgtagtcctggaaggtagtggcgatggttcctgaaaccaacttcgcctcatcccgatcccggcgtagctcatcccgctgttcacgggtgaaagccagattctcccgaccagcagccatggagagtgcatgggattcagctgcccggttagccgctgcctgtgcccgttgctcaccagctgcacggtactgccggttctggatagcatcctgtacgccagtcagttccttgcggatctcgccctcgttgatcagctgttgctgggcaagaatctgattgacctcgccagtacgaccttcagctgccagggtacgaagctggtctacgatatcccgttgacctacctcggcctgcatgtcgtcgaacttctgagtagcagccgcttggttctgctgagcactgatctgcttggtgatcgcatcacgtgtagcagcccggtccaggttcatccccatcgcatcacgttgggcctccaagccactgcgatagtctgcgttgctgagttgttccagagtggatgctgccacctggtccagatagctttgcgtgttggcttcacgctgcaacttggcattgttgacgttcatctcctgctgacgggagatgatgtcacccaatgcaccaagtgcttgttggacaccagtagtcccagcagacatcgaagatgcactgccaggacttaccgttgcaccaatgttacgccaagtgatttcttgggccattagcggatccggttccggttcatgtaggaatccacggactcataagccgaggggttggatgctactcgtgcacgttgccgatcttccaggttggtattgatcgactggcgttgagcgccatagttcatgtcgaactgacggcgagactctgccagttgatctcgtgcagcacgctgctgtcgattggcaccaatggcaccgaagacagcttggccgatacccagtgcaggcattacccagccaccggtctgagcaccgctcggagctacaccaccgaacatggaatcacggctgaagatgttgctgaagccagacatgaaaccactgccgccagaggcagcagcgttcacatctacagcaggcatctgcatctgtagttgagtttggggaccacccaagccaaaggaaccgagagtggaagtgtccagctcgactccgaaaggcatatcactgtacggataggccattgttgatttcctctatggtttcgtttatggaaggaagctgtagcttagcatctacgaagtattccgtcagttggaagctagcagccccgatgttccctgcgtggacagttcgggagaagaagtcatcagtactttcacccaggatagtcagaggacggttcacgaagtcttcaccctgaagtgcttggaactgaaccaaaccaagttcacgacgttggtcttccagactctggagttggtcagcgtagtacgtctggttccgctccagttccttcaaggtatccatcagaccagcttgttccatggtctgcgattccttggcgataccatggctcacagccatgaggttctcgctccaggtagcgttgttggacataccataggcaccaacagccagggcagctaccgcagccaggatgcccaactcaggaccgacagcacggacgaacagcttcacaccgtagctgacggccagggtagtgacgatcatctgtacgatcaccatggtcagagcagccactccaagagaggctgctgcgacgatggttccccaggcactaccagctgtgaagatggtgactgccacagacaccacaatcaggatcaccttgaagaagccactggcataccaaggggtcttgatctgtacctgggtgttgatcgccatgtgcaggctccggcacaggagttgttcctgtgctctcaagccaagctgactgagtactactcggtccacaggaatcagcagttcaggttgacccagttgggctacgtgccctttcttgctggtgatctggtagtgcattgccgggttgtagatgatcacctcgtcgtacatggagtccatggcctgacgggtgtaggtatacgccggctgctgggtcttgatctgtcccgaggacttgtcggccataccagacttcacattgatgaaaccaataggtccaaccttcccggacttacggtttaccgtgataccgctgaaggagaagtccatcttgaagtacttgtcccgcatggtgatcatctggtcagccgtgttggagtaatcccctagcttgccctggaggttctctgccttctggatctgagccaatgcctccgagtggagcagcaacaggtactcgaagatgtatgtcagctggtcctggttcgtggcacctggtggcacaccgtagaacaggactacctgagccacgtcaccgatgtcagggtcagcatgaaccccatcgataagctcgtcgatcccaatgccagagatcttggccacttccttcacatccttgtaggcattgcctgggatgtccttcacgttcatcttgttgaagcggcagtacatccacgggtagtaggtaccctgcttggtgtagtcgaggttgaacacaccatcgatcagcgggtaggttcccttgccgtcctggtaggtgaagaatccctgggttccattctgcctacggaaccgaacctgatggtaatccagggacaggtccaggttcatgatcatgcgaatggtttcctgcttgatgaccccctgggcatccttccattcgtaggtcagtagaacgtagtcctcgccgaaagagttgtccgtccgatagggtgaccacccagcgaactgacccattcccccaatggtgttgtacggacggcttggcgtgtacccagacttcggactgaaaccaaaatcctgaagcatgcccttgttcgctgtctcgtctgcccatgccacagtgtcggtctggaagacggggatcatgtcgaacaggtagaccttcgaacccttcgtggtgctgagtccaggcagttcattggtcagcgggttgtactggtacagccgcaccaattcagtgaatccccagtgcagggagttcagcggaccgaactggttgtagtaggtggtgatagtaccctcacttcgtgcaatggtttgaaccactacagtacgagcatccacgccgttcactaccttggactctggcaagccccagtaatagttattacgttgtgcccacaggtaggcagtattcgcccgtactccaatggagtcggacagcttctctaggatgttctcgacgatcccagtctcgtgagtgatcccctggatcacaccagtacgaggagagtccgggatgcgtgcatcatcgaacactcgttgcactgtagtgttcaccacagtcttcttcttactactgaacagacccatgctgtcctccaataaaaaaggggaaccgaagttccccttagtgtacagcacgctgtttaggcaccgacaccagtcatcagcatgttcactacccgtccgacgttggcatcgtccagccggttggtggtgttggcttgagtaccggtatcagtggtgcggcgtacgttccaggtatcgatcaggatcttggcagccttctgctcagcgtcacgcttgaagccatcagcctgagccttgtacaactccttctggcgaccgatcacagagtcggcatccacaccagcaccgatggtttgagcacgttcggaagctaccttctggcgaaccagaatggtctgctcctgggtgttcagaccttggtccttggtcagatcgaattgagccttcagcaagcattcctgagccacgaggttcaagagttcctgcttcatgttcaggactttctgggtggactccagtacctgctgttccatgaccttggtctgttggacagcagtcagtacgtcttgcttggtcttcgcagtctgctctttcacaagcaggtcttggaaaccagcagacaggatctcttggtcgatccgacgagtctgtgcagtctgtaccttggtctgttcctgaaccagaagatcctggaagccagcagacttgatctgagactccggcagcttcgcttgttccagggtcagtttgaccttggcagcgataagctcggcgtctttgtcagcctgggcgatctgcttgtccagcaactcaccttgcttctcggtgagcttgatctgtgcttcgaccagtgcagccttgttggcggcttcatccttctgaagcaaaaacatcacggcgttctgaagaacagccgtgatgccaccagtgagaacagctgcgtactcctgccccttcaaccgccctgcatcgtgctctttggccagatgcaggcgggtgacttgcaggagttggtcgagagcacctttaccgtctagcttgacctcggtgaggtcggcaatggtaatcggctctacggccatggcttagtcctccttgaaggaaccgttgactgcctgctgcttgcggagggattcgagttcatcctcgctcagctgcggcaggatctccacggagaattcacgtaccgacttcgaccggcgtaccttctgcggacccatcggggtctgctcggtaaccgtgtagaagtgctggtactgcttggacttgatgaagttcagcagggcttccggcacatgccagtccacctcgtacggaaccaggcggcggatcgtaccgatctcgtcgttaccgatgctgaagtactcggcatcccagtcgttcttgttcgggttgtggcaggtgatgcggcagcggatcagacgatgcgcagccagccggcgatcacgacgcagttcaccctcggtcttcggacgcggtgcttcggcggccttgagggcagctgcaccagcttcggcggacggcttcgggatggacgaggtagcttcggtggcttcgtcttcttcctcgtcgccgacagcttcgtcgttcaggacggcattgatcttttcacgcagcttttccacgccggtattggagcggaaggagatgccgagggcagtagctttttcttgcaggacttccaactcggaacgggtatccggggattccagcggtgcttcactcaggttttgcagttcgtcgagagacatgggtgattctccagggtaagagttaagagggggaggttaccctcccccatgcctagttacaggcgtgccacggtcttcagcagggcgatccactcggggcggaacaccatgaagccgtagtaccacttgatggacatgaagcccatctcgccgtacgggtcactgcggtcggcagtggcttcgccaggacgcttggtgatgatcttgaacttgacgttcttgccatcggtagcgaaaccgacagtggtgaacgcctcggaagccacacacagcatcgggaagacgctgtacttgccgcccgactcgtgcatcggaacctggtcgttcggatccacgtccttgccgacgccagcccagtgcatcatctgcgggttgacgatgacgcggaagcgacccagctgaccgacttcgccgtgcatggtggcaccaccggcagcgtacttctcgatggggatgaaggccggattgccgtggttgtccttcatggcttcgatggtcggaaccagatcggaaccaacgtacagagcacgggcgttgcccacggtacgggtgtcgatcatgcgggtaccggtgatcatcttgatcttggtcggcgcacgagcgttgtccaggtccagacgcagacgcatcagcgaatcgtaggtgacctcggtggtcgcatcgacttcagcgtcggaggtagcagcgcccggataacggacggtgccagccgagttgagcaggtcgatctggagcaggtcttcggtgatctcgttcgcgcccttcaccatttcggtggtgacgtgaccttccatcgccgggtcgctgtcgaagtcgagttgctcttgggtgtattcgcggaagaagccgtacttctccagcttgcccttgatctcgacacgcttgaaaccaacacggttcacacgaccgccgatctcggtgagggtcggcattttcgcagtgatgttgcccacgtcacgactcgaaccgtagaggttgccgttggcgatggtagcgccggaagcgtcgatgccctggtcgttcacgttgcggtcgtcgagcagcgggatgtagtgcagtcgtacgatctctttgccgtagtgcttcggcatcgagaaggtgtcggccagctgaccgaagtacgcttccttggcggcgtcgatgagcgcacgcttgtaccagtagcgggtatggatctgaggaccgatggaagactctaccccgttcgcggggtcgttgtacttcatcggcttgatgttatctacaggaccggccatgagatgttttccttattccagtttcagggattgcttagttgaagcccagcttctcgaactcttcgtccgacatcgccaggggatcgaactgggcaggcttagccttaccagctacagttttggtcggagcagcagcccgacgcttttctttcacagccgcttcctgtgccttggtgcgggtggtgactcgcttcaccggttcagcgggtgctttacgctggctttcagtggccgaggcttgagccaaatcgtcgaatgcaccttgagcctgaagctcatccccaaccgccttatatgcgtgcaggtacggggtactatcagtgatcgtgccgaatgccttacggcgctggatctcggagtcgattcggtcgaataccccattggtcatgtgctgttcgaagtagccgatgacttgaggatgttcggaaaccaactgctgagactgtttatccaacttacccagcgtagcaaccactcggttataggatggactgtgctcgatggaatcgagttgttcgtccagtgcctcacgaacttggttgaatggtacagcagtcggtttgtaatccgcaacactcttctcatccaagtcgagcggatctacaccggcatctttagccaacttagcgatggcttcaggtttcttgtgtttgagaagatcgaccacattggcgatagtctccgggttcagcaaaccagcatcatccaactgacgcatcatgtgcaggttcggcttgagcgcggacatcttgtggttgtagttggcacccatctgcatcagacggatagcttcttccggggtcttaacctggagatcacgaccattcgctttgaacggtgcagtaatcttcgccatgaagtcagcaggatctacctcttgcttggtagcctcggacttcttggtttcaggttcttctttggcaggagtatcttccgattcctccttgccttcttctttctcttcctgctccgactcttcttccgtcggtttatcttctacaggaagatcgccgagttcatcgtccggcgaattgagcggatcttcttcctcgctctgttcatcgtcctgttcttcttcagcaggttcttcttcctggccggcgtcattaacttgctcgtcgtccagttgttcctgctcgggttcttcttgctcggtgcgagtctgctcttctacctcgtagaactcgggcagatcgtcgtcactcatttcgaggaagtcagccattactcttcgtcctcctcttcacggacacgttcgagttcagcgtcacagtccttgatggcctgttcagcttcgtctccacgtacgccgatcagctggaagtaggtgtgcagagcgccgaccgcatcgatctcacgaatgatgcgtgcctgcatctcgggggattccatgttcttgtccgccttgagtaggaccagacgtgcagcgttgtccttgaggaagtcattgaggatcagcgcctggaagtcccggttcttgtgcagacgcagcattgcgtcacgaagccggacgaacttctcagcgttcttccgggtaatctgaatagcgtgttcttcgttcatctttgcaaatcctgtcaagtaaaggggtgttggttcaccgtaaaggtgaaccaactatagagaagttaactacttttgggaagtccttgctgaagtagcttcttccagtcgcttgagttggctgttcaacatagacagcttgccctgtgcttccgactgagcctgttgcagttcacgcttgcgtgcttgctgtacaccagactcctgctccaggaagttcagatcggtcatgtcagcctggctggagagagcacgagccttggcttgttcagtaccaaccttcgaatcctgcaagccagcaccagacatgtagtgagcagcgcgtgcacgctcagcttcgatctgtgcctggagcagcatgagttcaagctgcgccttctgctgtgcaatgggatcaggctgcggctggaactcccgaatacgcttggcgaagtcaggcatcttcttcagttccatgatctgacccatgatctgctgagccatcatcggatccatattcggacccatggtttgcagcatgaaggtcaggtcgttgaccttggcgttgtcctcttcagcagtagagatgtccagcttgagatcgaagttaccagcaaggtcatccctgcggatatccacgaagtgctcattggtgatccgtaccacttccacatcgtccaggaactcagcgttcatggcgatgatcttgcgaccgatctcgatgatcccagcagagagacggcggaggattccaagctcacgcttcgacgcagcatccaatgcaccacgtacagcagtagcggtgtcaccgagtgcagcaccagagatgccagcgttgaaagccttcacgccagtcatggattcagcttctgcttgttgcaggttgatcatgtactgagcggactgtgggatctctgggaaggtgtgcatgtgcacagcagcccgtgggtctgcaccagggttgaactcgtagttctcacctcggtcgaaacggcgacggttcgttacgtccagtgcacccttcatcacaccgacttgaccattggccgaacgagccatggtgtcgatcatcccacgggtgacagcaccgatgatccgctggttgtcgatgagcagagcaccatcactctcgccgtagagatcccgcttccgggggatgtagttgaccaccacgtaggggatacgcttgtccgggaatgggttctcttccatccggatcatcacagcaccaacccaggtagctacgatgggatgcagaacaccatcaccatggatgtcgtagtaaccccagtactcgtgaaccacgagacgcttacggctcttgtcctggaagtcgaagttgcgtacaccttctgaaggtccggtgtagtccggttcggatagaaggttctgcccttctacctggatcttgtccaggttctgataccgaccgtcagccttcagttcagcgtaggaactctcgaaggtttcgatgaggaacttcgccttgctgaagtcactgccacaggaagggtcgatgactatgttgttgtagtcacacacctgaacagtaggatggttctctaccgtctcttcccgttcttcttcttccgaaccaacaggcactgcccgtacctggataccgttggcttccgtctcttccaaaccaagacgaacatcctcggggatctccgggtactccgaaggactctcttcccggatctgtgctgcggtctggtagatctgcgccagttcctcggaactgtccggcatcatctcgtaggtgactacctgctctttcaccgtacgggattggtagttccagcctaccttcacaatgatcgtaccttcgtctacaccagcacgaacgtactcgtcgatgaaccgctgcttgttcagtttggtattgaactgttggttcagtaccaagccgttctgccttgcagactcagcatcttcccaggtgaccgggttcacttcgaagatgttggggctggataggaaaggttcagacagagacgagtatcgccactctgcttgcttccgaatagtcggaggctgcacagcggacttacccttctccgtcttgggctttccttcaccacggacatgcatgtagtcgagccaacgattgatctgcgtgatcttctcgtcggtgacctgcttcgcctcctggtagtcttgcttcagctgagccagtgagggagcattgctccactcaggctggagtcgcttactgggatccccatcctcgttgggtagggtcaggtaatcttcgtccacgtctgccatagttactctctttcaaaccaatgaggtaagaatcttggaaattaaacaactgagtccgaactttaccatgcccgtgcgtgccagtgataccgcaggcgggtacgacatcttcatgccggaaggtggtgtggcttacccaaaccaaccaaccaaggtaaagctgggcttctctgctgctgtaccggaagggcatgtagccttactgctgcctcgctcgggtacgggaagtaaagcaggtcttcgcctgcgtaacacctgcggagtgatcgactccgactatcgtggggagtgggtagctgtagtctccaccgaccgcgaaccattccactgggaagccggtaaccgtgtgcttcagatgctcatcgttccggtggctacacccgaacttcaactcgtcgaagaactgtccgaaaccaatcgtggtgaaggcggcttcggctctactggggaataacccatgcaactgatcaaagagtacgaacacgccaagcccctcaagttcaagggctggcaggtaagtgaagaccacgagcagaacgtccaggcactgcaagagatgctcggctcgttccccttcatcacggcagccttcggcgacaacgctgatggcgaacgtgtctactccctcagcaacttcaacgagggtgccaccctggacgtgaaggccggcgaatggatcttcgtcaacgaagaaggttccatcgaaggctggtccgctgaagtcggcgctgtccgcttcaaggaaatccaggcataaaaaaagaggggaccgtcctggtcccctcacccttacacccaacctccccttgtgaatcggtcctggtttcctaccggatcgatacgcaagttctgtgcgtccagattcgcacactctgcttcgtacttctgcgagaagttgaacccctcttgtgcagtgttctccatgaagccaataggagtctggcaacgtgaagcaacaaagtacagcaaagcttggaggtgagtataaggcaaatcaatgtcgatgcaaccccaactgtccaggttgtccacacagatcttcatcggtgtaggtgcacgacggtaccgtacttccagagtcttactcgacgaatgacagtagaactcatcactgatctccagtacatcgaactcaggagtagtgatgttgagcggctgccaggtatcgttgaggtagtactccactccattgtccccgatgatcttctcgatcttcaggatggactgtctgcccagcttgttcccctcagtgatgaactgaggtactccaggctttggcttctgtcctacttggtatgcaggacgtagaggatacaacctccgaccttcttccagttggatcttcagcataccttccttgagcaggaacctcttgtgcaggtccagtactccaaggttgattgcacgaatcagcgaaggaactcgctccagtacgagagcaccagtgtcgatgttcacgtacttgatgttgctgagttccccctctgctagcaggtcaatgacctgcttgagttggattgtcatacgatgtagctctcccctgcttggtaggtgttctctcgttgagacgcttcttcccagatcatctcgctgtcattgtactccatgcggatctcttggcttggagggattggattcatcaaagccagcatagagatggtgtcgaggaagtcgtcgtgcttggacctgaagccaccggctgaagccaaacgaatctcgtcttcgaactctaccatgcaccgtgtgctcttcatgtcgtaagggaagaacatcttccctcgcttgaaatgaggaaccatggccatgaaccgctccagcttgttggtcgtaggacgcaagccaggagtgctactacccttctccgaaaccatgtggaagtagacatccttgttcaccatctcccgttggatcagtgggatgtacccgccctgctggccggagacttcgatgcctactccaagtggacgccacttggcacacaaccggaagagatcatccaagttcgctcccatgtcctggcgttcacagatcccatccacccacagccagtcttcgttgtgggagtaagcccagacactgatcacactgaagtcactcgccttcttcgcagaggtagcgaagtcagtggtgatgtagaagttgtaccgcttcttgttgtccagtacgttgcgccgcatgtaccaagccacctcaccatcctggatgagtcggtcttcgtcggacatgatctggagcataagctcttggttgaacgtctcgatcttccctgccttcttggccagggtgtacttctgcaacacgaagtcgtaggtgaatcggtcagcccatgcacccctgaactcttcccgtgagcacgggaatctctcgcacacagggtagacgttgaccttccaggcaccagactccactgctttgtacagtggatccttcgcgttgaacggtgtacccgaccagatgatcatgttcttcttcgggtgcagtgcgtagtccactgccttgtacaccgtgtcttcgatggctgcgatgacggttggcgagcgagcatcttcgtccgaaaccaagtcatccagtaccgcaagctgcggacgcttacccatctccttcgcaccacggacaccagtcttggcaccgtagcccttgacgatgaagaccttcccgtccaggttcgtgaacttccagcggatgtcagtgaagttggtttgggggatgtacttcttcaggaactcagagttctcccagcggaactccaggttcttacgcatgttcttcacaccgttgtcgatggagtccgacacgtacagagcaaggtccaccttaccgaaaccaggaagctcaccgtacagtgcaatgtacaggaacaggtactcacccatcacggtggtcttggctgcaccacggaataccatgttggcgatccgagtctggccagagccaatctggtcaagcatccgtaggtgaagcactggtgtcttgttctcttccccttcgttaccgttgaccatcttgatgaagtcaacgaactgtaaggcaaagatgctggggatgtacgaagagtcatccccatagactacttcacgaagccattgctctacagacttggcggcttcatccaagccagcgaagtccacctcatctgcaacagcttgcgctattggtgtggcgtccaggttcattcgatgatctccccttcgatcacttcgccgaagtccatgctgcgttcagctacatccttcgccgacatctgcttgcctgcgatcatctcctgctggagtcgagcaagtgcttcagcgttctgccgcatgatgtcgatggcatctgctgcacggtcactgacatcgatcttcagttcagtcttctccggcgacttcaggtgagtgagcagactgttggccgactcctgctggaccttctccgactgggcattctgcatcaggtggaacagatggttgatcgccttctgcttgatgtcagcattgagcacatggcatgggatcagtgcctgctccaggatgaggttcaccagcttggacttgttgtagctggtgatgtagctggccatgtccttgttggctacaccttgctgggtccaccgctggatcttggtggggaaggtacgggtgtaagcctcggtgttgttcaaccccatcagcttataggttacgtacttcgaagcatgaaggtagttgtccagcttgaacttaccttccttcatcacatgggtgtacccaatgatgttgtccctgaaggcttctgccatgtcaggatcagacagcatgtcattgagagtcttcagtacttccggggagatggacttcttcatcttgtccggtagcacagagcggaattcatctaccgtcaacatcccaggctgagcagtagtggcgggagtggtggtcatcttagtacctcggttgtctataggttgtgccgaggataacacaacgtacaaaccaaggagtaaaccatgcaactagaaccttatgcacggcacatcgtgaacggggaacttcagcctcggaatgcacgagtggagtgcggcaccaaggtgttcctcttggaggacacccttacccacaacaacgccaccggaagaaccctgccgctccgtgcaggaagccaggtgatcgtcatgggtctgcgcatccagtacacggagaaagggaacatccccatggtcgcagtccacagcatcaacgaagacggcgacctcttccattctctggtagaccctaaccgtctctgctatgcagagtgcccggctgaccgtgtactcaagctggtgcatacagaagagatggcaacgatgctccgtaacaatggttacgagcagtcacagaagatagctgagcttctctacagctacggtgtccatcgtctgcacgaaggtaagctctgatggacatcagctatgcgcatgtccagatgaagctgaagaatggagagactactctccacaaggtagagatcccctactcactgagtgaagtacaagagagccacatcactactgtggctcagactctcaatcttgtacggagggagactggcatctctgttctgaatgtcactcactcccgagtactcttcactgcggggccaagccaatgaaaacagactgggtagccaaccttctggtggcattggcttgggctgtcttcgtacccaaaccagcaagcgaatgcctgctgtggttcttctaccttctccacttcaccctggccttcctcctgtggacggcggtggatctggtaaggcactcacgcgaatggagggataagcctgtcgtggctttcttcttcttcgcccccatggttcccatgaacctatacctcatcatgcaagtactggagctactatggaactgaataccactggaagggttcgcctgaccttgaccatccaaggacagaccttctacatcaatacccacttcaccagggaagagtgggatgagaagcacaccaccttcaagatgcagttcgtcaacgatgccatccttgctgcggtgactgcctccgcccagatgcctgccaccgaggaagccatcctcaagaagcgcatccatgacctggagcaggaggtggcccgcctgaagaagcagggcacccctaccatccgtgtcgggcctggggtaaccatcgggcatcttcccgaccaacggtagtattccaggcacaaaaaaggaggccctaaagcctccttctcccccctatataatatataggtaatcccccgtgggtgagtaataccaagggtaccacgaggaattaccctcgtcaacccctcgctacgctcggggttgactcgggccgcaggcgccgaggctcactactcccccacctcaacgcacgtgaggtttatccccaatgagcaatgaagcagtactgaacatcaagctaccaggacaagaactggtagagatcgaccttggtatctcctggcatgagtacatcaacaatacaggagatgacaacactggcttggtttacgtcaagctggctgagtacgctgaactgtttgatgtagtacctaacaacccagcagagaagaagatagctgaactggaagccaaggtaaaagaactggaggacaagctccaggctacctctactgaagagaacagggagagtttcctgtgcagggttgccagtcgtggttctcgtaagcatgctgacatcgttaagaagggtggcttgttctactgggtaggtaccatcaggggtacgacactcagaatggagagtaccttcatggatgcagacttcgatcctgtcatccgtgatgcaagggattgggtgaagacacctactgtaatgagcggcggtcttggtgtactggtcatgagtgatcgagcaagaaaccacagactggaactctattggtttgcagctactggcttgttcactggtgtagccactcacacagagactggcttagcctacgtatcaccagtgaagcataaggactggaaggaagcatggagagagcttggctgctacatccaaggtaaagactagggtgtgtatatcctgtggataacttgactatagatatccacaggtatccataacccatagcttcggaccagtcatcctgctcacctcgctgcgctcggtgcttggcgacttaacctcagctatgggttatgggagctagggggaaaggggttggcttagagagagggaaggtgatttgggttaggggaattttgctcatagacttgtgattgcagtacttcagtctgcggctctccaaatccggttatcccccccggtacctctagagttttggaattcccgcgctacctaccccaccttgtttaactctccttctacccaatcatctgtctgtacttctagatcaagagaagccttcggctgtgctgtggattgatcctgtgtcaccacaaccattctcactactctggagtactaccatgttcaaagctctcaaccaattcttcgctatgctggagtccatgttccgtgctgtcaccaacctgaccaaggctgcggagaacgtaaccgagtgggctgaagaagagtctgctcacttcaacaacaaggctcgtctgcaacgcgaacaagccatcgcactgctcaacatcgagaacgctgctgaacttcaggagaagggtctcaccgaagctgtcgagtccgtccgtaaagaacgctccaaagccaaggcttaaccctgtctacccactacctctactccctaatccggagtagaggttaccttttcaaagcacacataagatcaagaacacacacaaagcacacacctctctctcagggacagtaggttgtagggagatagggatactctctgtgattactctctactcttcacagtcacttacctcgtgtgtaggaggataggggagatagtgg

SEQ ID NO: 23 - DNA, 64427 bp, Myoviridae Pbunavirus
  misc_feature (1)..(64427)
tttccggtttcggatgcagccgcaaaagtatactacagcgaaaatcgattgcacaatcctaatagaaaaaatctatcacggacgttacctatctttaaaattaataaaattaatagtaatttggtaatttggtatactttggtattcgaaagcctcgcggcactaagcctgtacactaccagtcaagtttccgattccgctcaactcgcggcagggtcgccggaaacttccgtccttccaatccatgggcagcggcaacaccacggcggactaagcggcagggcccaaaactcgacgagcggaaccggaaatttggccacagggcagaatcgctcagctggacatatttctaacattcgatttaacactcaacccaaacactcaccaccaccatcgcccgccaccagccaatccgatcctcacccaccagcagaccgcccatataacatcctataacaccacctaacactcattcaccatcaaacccacccagacctacaggccacccacaagcagcccatagacgcgatccctggccccatagtacaatcgcgccatactcagtgtcgcggcagagcaccaggggccatccgccaaccaagccaccacgacgactccagaatcgaactccagggacgcagcaacaaatgaccgccaaatcctacagacccgacgatttagtcacgccacaagaattcgctgatccgcagttcgcggcgatcaaccagaagcgtttcgatctgtacatcgacctgcgcgttcaaggctatagctcctggcgggtcttccgggcgatctggggcgaagagcacatggacgggccggcccaggctcgcatcttcgcgatggagtccaacccgtactatcgcaagcagttcaaggccaagttgaacgcgaccaaaacgtccgatttgtggaatccaaagacggcgctccacgaactcctccaaatggttcgtgaccccaccgtcaaggactccagccgtctgtcggccatcaaggaattgaacgttctggctgaaatcacgttcgtggacgagtcgggcaagaccaggatcggtcgcggcctggccgacttctacgcatcagaagccgaggctcagaccgcgaccgtcgctgctgcggccgaagccaatggctatgttccggaaggcgaagagggcgatttcccgtctccgtctccggaaccgaccgaggaagaccgcgccaaccccatttagacataaaataacatcgttctaggcccgaatcggaccgaactaaggcgaaggtagcgggaagggacgaaaaacgattctagggcggttctaggaagtcgtcgcctaaccctcagaagcgacaaagccccggactctagttcagaatccggggctttcttttgggcttcttattctccagcttcgatgatttcgaagttgtatttgacgccttcgtgctcgaaagtcaatttgccggcctccttcagctgcatgcggaagcggatgtgcttcgaagagggcaggccgaactcgatgaatgctgcgttggtggaccggaactcaccgcgcttccctttgacggtcaccgccacgccatgacgctgggtgcgctttttggagacttccgggtctttccaggagttggcgatggctgccgacaggtctttggtctctttggctttctccggcgcgttcttggcctcttcgcgcatcttccggatttcttccagcgcttcctcttcggtgacctcttcctccggcttcagattttcttcttcggccttctcttcttccttcttcttggaagtgcgggttttgtaaaccttggccggggcttcctcttcctggaaagcttcttcctcggccggcagagcgttcaggatggcgaggcagcgacgctcggcggtcttgcggtcggagaagcgcttgacagtcgcatcggcgttgtgggcgttgtagaaggcgaccagttctttcatttctgcgttctggatgtcgccgaaggttttgatggagttggtcattttgcgatcctctgttttggaagatttcgttcgggcttcagcttgtcgccccgttgaaagagattatgcctaggtcgatgctgcgtgtctacatttatttcagcataatgacgacgaacccgacgaacggttgtcggatgtgaaaacaccgcaggacaggctgcggtgttttctggacgatgctgcgacggtcagaaggtcgggatcggctcgacaggcaggtcgccaggcttatcgttgtccgacgcgggagacggactggacgggatggccccggaccgaagccccagcggttcaggccgcctgcttacctgcggtgccggaggcgcgggcggagcttttggtgctttcggcactggaggcgcgggcggagctggtggagacatcggcccttctgggaggtcgggaaggctcggttctttcggctcgtagtgaaccgtcttgtcgccgcccggctctgccggatcgaagcccgtgaatggagtggtaacgcagcgcatgttcggatgggtaggtagatttttcaggactatggaatctgcccagacatacggattcttgtggttgccgggtccgtggctgatgatctcggcaggaatatggccgttcatggtgagccattccgccatcccttgccgagtcagcgggcttaccacgatctgaccagtggactctttggcgatggcgaacagatcaccgaattcgaatccgatgattgtgtagttggacctggactcgccgacgaaagccagagtttcgatgttgtggtggatatcttggtcttcccagatgtacagcatggttcgctcctcaataaggttgcttttggtgttcgaccagagacataccggccggaactttgaagcggacgtattcgatcatcatcgccgttcgacgccgattcgtgcccgactcgtcattgacgaatagttcgcactggtgcggaatgactcgcgtcaccaggccttcgcctttcgagccgtagaacttgatgtaggccgcgacgcctcgcgtcatgttcagatggatcgtttcgcagagtcgctgcgcggccgacgcgctggacagatctgtcggactgaccgtcacccagtaatggccactttgttctttgtcggacataagctgccctccaatgagaaagcctctgcggatcggcagaggctggttgttgttagtcgcgcttcaacagaacgactttgtcatatgcgcgatatttaccgcgccagtcttcccagtattcgccggccgggcagacaagctccagagtgatttcgtcgcgccagcattcgacagaaaggacaattgccttgttcctggctgcggaatccgccctgagcttaatcagaatttcatcgcccgttttaagctcatcaactctcacaactttagccatttcattctcctattgagtagcgccacgaggtggccatgtcgcttcgatgtcctgtaagcagatggtaggatagtccctggccaacttgagcttgaagtccacccagtcagcgccgatgagtgccgagacttcgatgcttactttgctgtgcggcgcagctccagatcgcaggactatggcccgacgccgaacgggatcgttgacgtcaacatgagtgagtatttcgtcgccgacgagcaactcacaggccatcaatatttttggccatcatacactcctatgagaaggcgcggccaggacgatcccagccgcgccgatggattaacgtttgtgaaggatggacactgcgtccacgtcgaggatgctaatggtacggcgacggcgcggattgctgcgttcatggatgcgaatcaggttcgcagctggagcttcgtccaccacccatacgtcttccggtttctgcgtccggagcaggaccgtcacttcagtattctgggcgaggccgttgcagatgaaagtgaacttggacgagggagttctgtacatttcgagattcctttttggacttctggttcggcttctcagccggtgaagagattatgccctgattctcaccgccgagtaaagcatttgtgtaccaattctcccgtcaggtggaaccaaagtgcggtatcgcttatggctacgctaccgcgccatggcccttcttgctcgcacactgcgaaccacaggctgatttccatccttgccaggactcggccgaaagattcgaacctgcgccgactggacaggatgtcgacattcactcgtcgattgacctcataccggcgaccgttgatgacgaagaccagccgcagggtttgtccgtccagacattcccagtatctggtttcataccgaagccagtagcgcttgccagccgggcctaccatggtcatccttctatgctcctggccgctccacggggaccgggcggtggagtcggatcgaatcgacccaggatgtaatcgggccgacgcgcttcctgcgggcagacggcgagaaggcgccatcctgcgtccagggcagactggagttcgtccgtgcagcagtcttccttgagcagcagacggttgacgttctggagattcggaccaggtacggccgatcctgtgagtgagttccaaccttcgacgccgtgcaccatctgctgttggttgatgtagccttcggacctgccagccaaccggcttgcggccagctccaggcgctcaagcatgggtcgcagagcagcttccgggtcaatgtcgtcccagagaaggaccaggctgatgatggtatacggatagtccttgtccagatcccaggctgaagcggtcagacggcccaggccgatttcattacacatcacgggaacgtcgttgctccaggtggacggctcccagttccgctcaccaggattcccgattgttacgccttccaggttccccaggagaacgtggagcttgctgacatattccgcttccaaggctttccgctcttcgtcggtctggttgtggcgatagaaggatggagggctgacttttgcatgatagagtttcataactgttcctcggttttggaaggcttgaacgttagagaattgtgtcgcagtatttctcgaaaggactctgacgcttcttctcgcagatcgcacaggtgatttccaggtcgggcagctcgctgtaagtcttgccgaggtacagccagcgcttgcacagactgcggccgtccgattcgaagaagtggactttgcgagcattgccgggttgcgcccagccgccttgatcgtttttgcgcttgctcatggcgatatttcctttggatcgtggatccatggtgtacgttcagtcacccaaactccatctacatagatcaggactgacagagcagtcgcgccaaacccgaagcctacatagaatgaaccgggatcgatttccatggcggcgctattgcaatcgacatcaaagtcgaatagcgaatggccactcataccatcaccatgtcgatttcattgacgaagaaatggacatcgacaccatcggcgcggccggtgtaacgcagccgagtcgtcccatcaatgtgggcttcctcgacgccgatgacttccaggatggtgtcgttgcagtacagcttgacgaacatcttgatgccggagccaatcgccgcgaaggcgatctgcttgtacaggtcttgcttgatcatgctttacgctcctgtttgcggatgtattctgccctggcctctgcttcgaacttcgcccagagcgcgttgtcgactggaccccagggcccggtctgagttccgtccaccggcgcgaacttgccaccggcgcgacgatacttggacagcgttctcaggctgatgattttctcttcttgggaatcgaattggacgatcaccgtacatactccccaaagtagcaggtgtggaggatttccaggcccttggagatagccttcagcttgatgccaaagttcttgattgcccagtccagatcgtggtgatagaactcgatgatgttgacgatttgaccggcgctgtagtggatgacgcgaatcttgccattccagcggaagtcttcgcggctgtttactgcctcgactgcgatggtgtcgtttctgccgatgttccatttggagctggtcatttctgcgttcctctgttttggagtgtttcgcgtttcgatgaggtgactatacctcagccacctcatcgagtaaagcagaattgcgaaatatttcgcagagtggacaaacggtctttcttcaggaatatttcatccatggaaggcatttccgcatccgaatgttgattaggtatcccaaagcgcgcagtggcgaatgtgagtccgcacgtacatagggttgtattgtgcgaagtgctcgacggtcgcatccaaggctctgctattgccgcacccttccgctttgcgagccaggaagaatgcttctatttgctggtttgcgttcatcatcttgccctccagggcgttgttcgtttcgctgaagagattatgccgttggtcagaatggaagtaaagtgtattaacaataaaattatgttcaccgacgaacggttgtgctcgaccgtctgttgcggcgtcgatatactcgacctattgctgacaccggattgattagaatgtacaaactcaaccctgcactgcgagcggtctggcgaactcgcgcccgttacaaagtcatttatggcggccgggcgtcttcgaagtcgcacgatgcgggcggtatcgccgtttaccttgcggccaactataggctcaagttcctctgtgctcgccagttccagaaccgtatcagcgaatcggtctacacgttgatcaaggacaagattgagaattcagagtataacggcgagttcatcttcacaaagaactcgatcaagcacaagaggaccggatcagaattcctattctatgggatcgcccgtaacctgtcggaaatcaagtctaccgaaggcatcgacattctctggcttgaggaagctcactacctgacccaggagcagtgggaagtcatcgagccgaccatccggaaagagaactcagaaatctggatcatcttcaacccgaacgaagtgaccgacttcgtgtatcagaacttcgtggtcaagccaccgaaagattcctgcgtcaagatgatcaactggaatgaaaatccgttcctcagtgagacgatgctcaaagtcattcacgaagcatatgagcgcgaccgggagcaggccgagcacatttatggcgggattccgaagactggtggcgacaaatccgtcatcaatctcaagttcattcttgcggccatcgacgcccacaagaaactcggctgggagccggccggatcgaagcgcatcggcttcgacgttgcggacgacggcgaggatgcgaacgcaactacgctcatgcacggcaacgtcattatggaagtggacgaatgggacggcctggaagatgaactgctcaagtcgtccagccgcgtttacaacctggcgaagatgaaaggcgcctcggtcacttatgactccatcggcgtcggcgctcacgtcggatcgaagttcgccgagttgaacgatgccagtcccgacttcaaactgatctatgatccattcaacgcgggcggcgctgtcgataagcctgatgatatctacatgaagctgccgcacacgacgatcaagaacaaagaccacttcagcaacatcaaggcgcagaagtgggaagaagtcgcgacccgattccggaagacttatgaagcggttgagcatggaaaggtttatcccttcgacgaattgatttcgatcaactctgaaacgattcacccggacaaactaaatcaactgtgtatcgaactttcgtcgccgcgcaaagacctggacatgaacggccggttcaaagtcgagtccaagaaggatatgcgcgagaaacgcaagatcaagtcgccgaacatcgctgactcggtgattatgtcggccattctgccgatccggaagcccaaaggcttcttcgacttctaaacatagaaaagcccggatcgctccgggcttcgggtcttactcggtgcggttcctggcgctgagtgtcgacgcaacggcctcgccgacttccagggcttcctggccggccgcgagcgcttcggcttccgactcgacgatgaaatcatcaccttggccatcgcctggcggaacctcgaccagcacggcttcttcgccttcgaaccgcaggtcataagtcttttcgacggacagtccgtaacgggcattgagcgcatcccagagctgagcttcatagttgcgcaggtcttgcagagatttctggtggctgagcatcgccatatcgacggcccgttgcagggtttcgtccaggacgttgaatcgcatgcgaagagaacgaatccgctcgaccacttccgcatccaccacatgtctttcgatcatcgcttttcacctttgctgaatgttacgttatagccgttgtcggccaaataggtaagggcaccttcaaatgaagttccgacgaggtgcctgagctgcatttcgcgttgcgcggcgatccagaaggccgtcccggagaactctgcgcggctttccgacagaacttttccgtcaggcccgtcgattcgaacgtgaacggaagatagcttcagagccattagtgaatccctccactggcttgcgacggcatgctttcagcgcgagcggcttcacagtccgggcagggacaggcttggcggacgcgctccaactcgtcggcatccatgacatagagcttcccatcggaagtgtcgtgcgccatggcgatgttcgggaagtcggcagcgctcaggccggcgacagcgcggatttcgtcccagagcgccacatgctcggcattcaggcgagctgcgagcgcttcgtgctctttcgctacacgagccatgaactcgtccatccggaatgcgaattccgcatcgatggatcgggccgaggccatggagttgaggcgaatcggttctttcttcatggtaattctcttttggttggcggttgttcgctgctcaggcctattacagtctgagcagcatgatgaagatgaacgcaaggaacgcaaacggcacaagtatgccggacatcagctttgacaggcgctgcatctcagcgtatttctcggttgacattccgtgctgcgccgcctcggccgcgaagcgagctttcgcctcgataacttccgggcgcagcgacaggacatattctaaggcctcttcccgcgctttttcggtctcgaccaacctagggtcgcgggccgagacttcgctgtaccctggcctcgcgggatgggcctgcagcgatggcggaagttcagcggccacgactccatagtcggcgcaggcccaagcgatcccgatgaggatcgcgaggatggactggacgattcgcaacatcactttgtcgctaggaaagctcatgatcagtcctccaccgaccgaacgatttccatgttgcgaccggcattggtcccggcagtgtaggcgcgccgaccgtcactgtcgtccagacgcaggagtttggtaacattcgacttcttgtaacccggatcgccgaaatgttcgtggaccgcagcttccttaaccaccaccagagacgttccggccgaagaaaccagctccatacgtttccgggtgatggattggaggcgatagctgatttcctgggtcgcggccagcttgaattgcgcggcaaccttgacgttgaaccgttcgaatccttgagctttctgatactcccggcacagacgatcaacggcctcgaccagggaattgaacatgttcaccgccagctcaacgtccgacttgtagcctttaaagcgaacggcatggccccagcgcttggtagtgctgccgtcgcgagcgctcctggacgccttagccgatgctcggtgattgttgatgccaccgacgaaatccatgatgcaatcattgtacgtcgccacagccaccgagaagaacttcatccagttcgggattgcggaatagtagcgagtagcaatttgctcgtcgaattcttcgcgaatctcaccggtcgcttcgaagtcgtgaaggtcatatttatccttcagcttcttcacgcgctctgccgcgatggcagcttcgtgcggactggaagagtcggccgccattgcagtcagcttgcgaatgcgatctttcgccttctcgatggcttcaggagtgaattcgttctggtcggtcatggtcggttccttttgtctgaaggtttcgcgtttcgatggagctattctgccttcatccagagtggaagtaaagcattttctttcattatttcggaagagcctggaaatagttccagatccaatcgcctgcggccagcaagaggatgagggcggcaaagaacaagacagcggccgcgagctgtgcgcccggcttcagtttgggatggctgagcttgggctctacgggaacggccggagcgctagcgctgcaaccggcgtctcctgggccgtagccgatgccgcgttcacacgcctggagcgacaccagggatttaagatactcggtctgcttttgcgactcttcgtagatgccggcgacggcgaaccagagggcgaacactacggacgtacacacaacccaggcgccggtcagcaggagggccagcgggccgatgacgaagacggtagcagccaggacgattgcgccgccccagatgatgaagccggccagaccattagtgatgtcgacacagaactttttcattttcaggttccttcggttacgggatggaggggatttgaaactctgcgccgccgagaacatcaatgacgacttcccagagcgtcggaacagaccactggtaacggtcgaagtcggtttcaggatcgacgcccagcgtcacataggaagtggcaggccatttatgaacactgcctttccgcatgagagtcgccacgcggccgtcaccgagcggattcgtcctgtgcggaacgtacgcagacatcgaatattgctgcccggcgtcgacaacaaatctttgcctctggcgcagacatacagagcccacaggattccagccgcgaccgccgcaagcctggcgagccgaagaatgctcataaccttcgtgagtcatttcgccgaggcaagccgagcgatcctcgtaatagttgatgttctccatcgatccaaccagcaccagagactcgaaatcgaatcgatgatcgtggatggccgagtgattgaagcaaagccgacgcggcagctccgggtgccaaacatggaggcgaccggccggaagttggacctgaatgaaccccaggccgtgcagagtgatcttgtccttcatcgggtcatggacggtgctcatggataatcctcagtagcagaaatgtattgtgagagttacgattgacaagccggtcgcccatagaagggcgaaccaggccatggctttgatggtcgtgtagatcatccgaagaattttccggcacagatcgggccaatgcccatttcgatggatgcgtggttggtcaactcgcgaccgcagcaggagcactgaccagtcttccgaccgtaggcgactgccgattccatcggcttttcgaacatcttcagaacgtcgtcgtgctcagtatcggtgcagtcgcgactcttgatgaatttgccattggtgatccggccgaggtagatgtcgcccaggacgtacaggctaccggcgttccggctgtgagcgctagcctctttcacaacaacgatgagcggctcctcgccttcgccagctaggcggattttcgggcgcttgataccagactctttcgccttctcaaacgctttctcgatgccggaaatgtccagagtcggcgcagcagcttcctgcacggccactttctcgcgatacttggcgaggttttcgatggcgcgcttcgcagcagcgatctgattttctgtcaaggagccgtatttatacaacgactcctgaaggctctgagcgaagctgaaggaatttccagtccaccactcgatgatgtccgggtgcgcggcttcgaaggccttaattttgaggtcgcgctcttgcgcagcgctacagattttctcgatgcgcttttctgccgccttagcacggctcttggcgcgctgctccgggctggttttgtactctttgtatccgacgccgccgcaggcaaagcaggcgcgaccataagacgaagggccacggtacaggccggtgcctgcgcatttggtgcacttgtcgcgatacagcttcacttccttccgggagttcgggcgggcacccatggacacgtcttccagggtcttcggcgcttcgttgttgatctctacggtagcgaagtcatcacccaggtcttcgaagccggtgaacagattctctgctgcgttcatgtcgattctcctgtttggaaagttcgtttcgatgagttgactatacgccagaagtggaaaaacggtagcgatttctcactaccgttcgtcgggtcgaagacaatcaataaatgtcgctattgatcttgaacccatgctcagcgccgtcgttgtagtcgtactcaacatagctgtcgcagtagtcgttcaaatgctgaatgatgcctagaacgtcgttcgcggccttgtgccttttcgcggcgatggtcttggcgatgctgtcgccgacttccagggtttcggccgtccggcgatggatcagcaggcgactccaaagatagagccggacgcgacgaatgatgtcgcgatggcgctccagtcgtccgtgcaactcttcaatttcgtgctcgcgagattttaatactcgtcgaagctgctgaacttctaattccaaatcggccttagtagccatgttcacctcaaaaaggaaaatcgtctgggactccaggaagctcgacgactattgttgagcctgatcggtctagaatgcatccgaccgagccagccctgtgtggatagggtctacacgaactataacaggtgacttccctgactattcgccaggtcgatcctccacaccatctgcaaattggcgggcgcttcgacttcagttttcgttcgtccaggacggcgcgtctgtcgcaggaaaggcagcgcgccttaaccgacgtaaccatgggtatagtcgatcattcggatgagtccatcaccctctgattctctcgacttaagaccgcccaaagagtcagactgaccgtcgcatttcgcgtcgatatccatggaagacagaaagcctgccgacactaatgtgatgtcaactttgtctccagatttcttgaagccttcgcattcagcgtcgagggccaccaacgcactcgcggccatgttgacgtgactgattaagtcggggaagattacgggaacttcacgagacattccacgaaccgtcatcttcagcactacatacttcatactcgctatcctttttgtatgtgaggaaagaatttgctgttttccggatggtggaaacgttcggccgcaggcggtctttcttccggacactgaatcgtcgaaggcgggaaaaccgcgctggagattatcgccgctagcagcgcagcggatgtcgacatccacagggcagtttccaggctgacccgcacttccggtcggcgcggcttcattcgctccaaccccttcccggctcgtaagacgggatgctgccgccgcgaatccaattgtcccacatatggttcagaccagtgggcggctggggcggcggactgtaaaagccgggaacttctgtgctgctgaggaaataaggcgtgcaaacggcccgaacaaccagctgatgtcgctcccacatcttatcaatcgctcttagcatgacgtcttcacactgagctttgctgtcgaaccgtctgctggtatgatccggcatctggacacagccatcgccagtacaaagaaaagcagtggcgatccatactgtgatgcttgccatatcgtcaccctctttggtaggtgagcagattttattccatctgctcgtcagaagtaaagcgcttttcgtcgggataaatgccgatgatgtccgcgtcaagcatccaaatgtccacggacggatcgttgctttcgatctggtacaggtgatacagctctttctcgtcacgcgccgattcgccgcgaggttcgacagccaagatacggccgtgcccttctccatgctcatcgcgatacatgacgcgatccccgactttatagcattcttttttgacgaggcgcgagcgcgagctgttcggcgattccactacccaggaatcaacaaccgcgcctttcacattgctgtaccacttcgcagatttgtcgcagtcgaacacgcccagaacttcgccgtccttcaacacgatatgtacgataggaagaagaggattcatgttaatctccattggttgataattagagtctaatctgccgaaaagttcccgtaaagaattattttctcataactgattagttgcgactgttaatgtgatgtatatgtttgaatctcttttgaacgtttgatgtttcccctataataagcgcacacaaccagcaaccgcatggaattaaaatgtttaaactttcctggatattcgggcgcaaaaaggataatgctgcctgttctgaatcggcgccggagaaagtcgcacgaatccctcagcacgatccgctcgaccctatgattaagcttgggaagattcgcggctggaacgtcgagccggagaaagctccggtcatccgtagcgtgaaggattttctggagccgggtctatccgtcgcaatggacagtgcgtatggtgacgggccgactccagccgcgaaagctgccgctggcggccagaatccctatgtagttccgaccatgctgcaggactggtataactcccaaggattcatcggataccaagcttgcgccatcatttctcaacactggttggtcgacaaagcttgctccatgtcaggcgaagacgccgcgcggaacggatgggaactcaaatcggatggccggaagctgtctgatgaacaaagctcgctgatcgctcggcgcgacatggagtttcgcgtcaaagacaacctcgtcgaattgaaccgattcaaaaacgtcttcggcgttcgaatcgctctgttcgtcgttgagtctgacgatccggactactatgagaagccattcaacccagacggaatagcgcccggctcgtacaagggaatttcccagatagatccatattgggcaatgcctcagctgaccgcagagtccacggcagacccgtctgcagaacacttctatgagcccgatttttggatcatcagcgggaagaagtatcatcgcagccatctggtggtcgttcgtgggccgcagccgccagatatcctgaagccgacatacattttcggaggcatcccgctcacccagcgcatttacgagcgcgtgtacgctgccgagcgaactgcgaacgaagcgccgttgctggcgatgtcgaagcgaaccagcaccattcacgttgacgtggaaaaggccatcgcgaatgaggatgccttcaacgcccgtctggcgttctggatcgccaatcgagacaaccatggcgtgaaagttattggcattgatgaaaccatggagcagttcgatacgaacctgtccgatttcgacagcgtcatcatgaatcaataccaattggtcgctgctatcgccaaaactccggccacgaaacttctcggcacttctcccaaaggattcaacgcgactggtgagcacgaaacgatttcttatcatgaagagttggagtccattcaggagcacatatttgacccgcttcttgagcgccactatctgctcctggcaaaatcggaatccatcgatgttcagctggaaatcgtctggaaccctgtggattccacaaccagccagcaacaagcagagctgaacaacaagaaagctgccactgatgaaatttacatcaactctggcgtcgtttctccggatgaagttcgcgagcgtctgcgtgatgatcctcgctccggctacaatcgacttaccgacgatcaggccgaaaccgagccgggcatgtctccggaaaacctggcagaactcgaaaaggccggtgcgcagtcggcgaaggcgaagggcgaggccgagcgagccgaagcccaagcgggcgccgtagagggtgcaggcgacccagttccggccgcgccacgcggtactaagcccctcgcgaaagcggccgaggaaggggccggcgaggccgctacaccgccgtcgcggccgaaccccagggccgagcttcggaacctgctgtccgatctactgtcgaaactcgaagccctggacgacgcgcaggctccggacggcgtggacatagagcaggatgacgcgccaggtctgaagcgaacgtcaaagccgagcgtatcgggtatggagccttcggtgttttcgtccaaccgcatcgtcggccctcgtgatcattctgaactccagaggatcaaggttaatggaattactaccttgatcgaaaatccgcgcggaagtatccggcaagggaaggacggtagctggcgagtccagatgaagcaccactatggattcatcaaaggtacgaagggggctgatggggatgaggtagattgcttcgtaggcccgaaccttggttcgaaacgggtcttcgtcgtcaaccaggtgaacaaagatgggcaattcgacgagcacaagtgcatgctcggcttcaacaacattaacgacgccaagtctggatatctgtcttgcttccgtccgggctgggatggactcggctccatccatgaagttgatctgcccgccttccgtcgttggctggcaaatggcgacacgacgaagccatttggaggcaagtgatggcgttcaaagcctccaagaaacgcgaacgccgggcgcctcttccagtcggaagaggcaagcccataattccttctgctggaatcgaagcctggtatcgaaagcaaatgaaggatatggccaggctcatgatcgccgattatcgaagtgaaatagagaaggccatatcccagcctgcggccgaacggtttttcgcgaaagatgaatcggtgaacgtcctgttcaagatgactctgcgaagcctacagcagcgatggagccgcatttttgaaggtttcgcggccaagatcgccccagagttcgtcaaccggaccgaagaagccgccactgccgcgacccttcacagcttgtcggtggccggcgtcgatcagccacgagctgcgtataatgagagcgtcaggaacaccctggaggccgcaaccacttacaatcatactctcatcaccaagatccaagaggaagtccacgagaagatttacacatcagtaatgctgtctctgacttccccgaatccggaagagcaaggaacttccggcataactaacgcacttcgcaaagtcgggaagttttctgaagatcgaatcgaactcatcgcaagagatcaaacaagcaagctttacagttctctgagcgatgagagaatggcggaaaatggagtcgaggagttcgagtggctacactcttctgccggcaagactcctcgccacacccacctggagaaagatgggaagaggttcaagctgaatgaccccagactttgggagggtccgaaagcagaccaggggccgccaggatgggcgattaactgtagatgcagaaagataccagtcatttgacatcgataggagcgctatatgccgttagttcatggcacttccaatgaggctcgttctgaaaacatcaaacgggaaatcgaagccggtaaagacccaaagcaggctgcggccatcgcttattccatccagcgcagtgagaaagggaagacggcgaaagattgttcgcctgagctcgtcgccgatcttcgcgccctggtggacgctctgtcgaggctcgtgaaatgaaccgcaagacgtgccggcgccgactcgtggtcgatgtaatcagagccaatattcacggcggattcttcagcctgaagtttgccgccatcgatttggcaatcatcggcttcgccatcttgatggcttttggccgatgatgctgagaaaatctggattctgactaaaaattctagtccggatagccgcaaattaccgtttacggaaaatggcagtaatttggaaatcctactgccgcgaggctttaacagagccagttcctaattccgatttagccgcatgcttcaaaagtatatagcatgggaaattagaagtaacgttccaatagaattcatctataagcaacgttataatataacgtcaatctatatactctagacgtattgaaattcaatttttaattggtaaattggtaatttggattagtttaggagttgaaagtctcgcggcagtaggcttagacaaatcccgtaaagtttccgagaccaaattaccggattttcgcggctgaggaaactggtaattagatcataatacaaattataatgtaagttaacagtcgcggctacatctaattattgttccgcttatttacccttagatgtactgcgtatataatacagccatagtccacgactcttcgaattaacgatgacaaagtcgaaaagaaaaattgacgaaaatggatatatgaccatcgagggctgcccgatcagctcttatggcgttttccagtattctgctggtcaactcggtcttccgggcgatccgacgcggattgtcaacgtatatcgcccggagtctgccgtcagcgatcctgagtacatcgaatctctgaagaatctcccgttgatcgacgagcacgaaatgctgtcgggattcgacgacgatgacgacagcgtggcccccgaagacaaaggggtggagggcatcatcacctccaacgcttactacgaagccccatgggctcgcggcgatatccgcatctattcccgcaacatgcagaatcagctggaaaggggcaaagaagacctgtccctaggctatagttgccgctacactgagcaacccggcatctggaacgggacgccttatgaagtcgtccaggacaagatgcgcggcaaccacatcgccctggtaaaagagggtcgtgtgccgggggccagagtattggatggtctgtgttttgaccatctcagttttgatttcagaccatccgatgagggtaatgaaatgagtctcaagaaagccaagcggaagccccctgtccagcgcgtagggcaagctgctgactcggcggtcgaagagttgcgcgccctgtggccgaagctatctgcgtctgtccagaagttcctgggcgaagaagagcaggagccggagcatcaggaaggcgcagctccggccgaaccgaccgacagcgagcacctgaccgagcatccgactctggaaggtgctcagaaggatgacgaagagcaggaagaggagccttccgttgtcgatccggccgtggccgccgtcgagccggagcatcaagaaagcgccgcatccgaaatgtccggtgaaggcgaagtcgccgaactgatctctcaggtcaaagccattctggctcgactggagggcacggtagccgaaggggcagacgaagagcatggcgaaggtcaagatgtcgtcgagggcttggaggagcagagcagcctcagcggctcgcaaaccgccagcgacgatggtggtgagagcaaggataacagcgaggaacttcctgaaatggcacagaagaacgcgcaagatgctgcaattcgcggtctctatcgcgacattgctgctaaagatcgcctctacaagcgtcttagttccgtggttggtgcgttcgaccaccgagctatggactcggctgaagtcgctgtttacggcgtgaagaagctggcgatcagctgtgagaagggccaggaagttctggcgctcgacatgtacctgaaaggcgtcgaagctgctcgtggcgcggccagccgtcaatcgaaagcccaggattcggccagttctgctccgcagtgcgccgagctggacagttacctgaagggggagtaacccatgttccagaaacaagtctatcgccagtacactcctggttttcctggtgatctgatcgaggacggcccgaagcgtgcgcggccgggtcggatcatggcgttggcatcggtcactccggccgcgactgccacaggccccaaccgcatcagtcgcgcgttcggttacgcaggtgatgtcggctccctcggtgaaggccagccgaagaccgttgccgcgcgcgcttctgaagtcgtggtcggcggcgccaacttctttggtgtcctcggtcatccgaagcactatgcgctgttcggttcggccggagactccctggctcccagctatgatctgcccgatggcgccgaaggcgagttcttcgacatggccaccggcctggtcgtcgaaattttcaacggcgccgcaaccgccctggacctggactatggtgacctggtcgcctatgtaccaaacaacctgcctaccgccgacaacgcgcttggcctgccggccggcgccctggttggcttcaaggctggctccatgccgaccggcctggttcaaatccccaacgcgcgtatcgtcaatgccatcagcctgcctgcccagtcggcggggaatctggtagctggcgttaccatcgtccagctcacgcagtaaggaggcgtcatgagccatatcagtaagacccattcgcgcctcgcaggccgtcacgcaaagccattcgacctgaagaacgtcacccacgaagccgtggctgccctgggtcgcatcggcctggtattcgatcacgccgtcgtccaggaccagatcaaggctttggcgaaggccggcgcattccgttccggctcggccatggacagcaacttcaccgccccggtgaccacgccgtccatcccgacccccatccagttccttcagacctggttgcctgggttcgtgaaggtcatgaccgccgcgcggaaaatcgatgagatcatcggcatcgacaccgttggctcctgggaagaccaggaaatcgttcagggtatcgttgagccggccggcactgcggtggaatacggtgaccacaccaacatcccgctgaccagctggaacgccaacttcgaacgtcgcaccatcgttcgtggcgagctgggtatgatggtgggcaccctggaagagggtcgtgcctcggccatccggctgaacagcgccgaaaccaaacgccaacaggcggccatcggtctggaaatcttccgcaacgccatcggcttttatggctggcagagcggcctgggcaaccgcacctatggtttcctgaacgatcccaacctgccggcattccagaccccgccgagccagggctggtccactgccgactgggcaggcatcatcggcgacatccgcgaggccgttcgccagctgcgtattcagagccaagatcagatcgatccgaaggcggaaaagatcactctggccctggccaccagcaaggtggactacctgtcggtaaccacgccttacggcatttcggtttcggactggatcgaacagacctatccgaaaatgcggatcgtgtcggctccggaattgtccggcgtccagatgaaaaaccaagagccggaagatgctctggtgctcttcgtcgaagacgtgaacgcggccgtcgatggcagcaccgatggcggcagcgtgttcagccagctggtacagagcaagttcatcaccctgggtgtcgaaaagcgggcgaagtcgtacgtggaagacttctccaacggcaccgccggtgcgctgtgcaagcgtccgtgggctgtggtgcgctacctcggcatctaacagatgcctattcaccaaaggccgggcttccggcctttgttcactctgactctaactcggttgtaggggccggttagggcataattactaggactacgccaatgactgtttatatcgtttcctccatgactcaatcggtgtcttacaatgcgtatgacacctctgatccgtccaatcctcgcctccagcgaaagattctgattcgcggccgcgcaggcatcgcatccgaaacttccggcttcggcgacatgatttccgacgaggcaggacgtccgatctggaccccacagggcgattgcactgccgtgagcgattcggatttcgagctgcttcaggccaataagattttcatgcgtcacatggagaagggttatctgcgagtcgtgaagaccgacatcaccagtgaccaccagcggatttccaaagagactcgcaccatggagcgcgatggattccagcctctggatgctactcgcctgcagcagaaaatcaaggtgaccacagccagcgcttcccaggaacaagagttccggatttaaccgagggtttcggcatggtgattttcgacgaaaataagtttcgcacgctgtttccggagtttgctgatccagccgcttatccggacgtgcgcctgcagatgtatttcgacattgcgtgcgaattcatttctgatcgcgattcgccataccggattctcaatggcaaagccctggaagcgtgcctgtatcttctgaccgcccacctcctgtcgctttccacgatgcaagttcagggcgcggctggaggtggcgtcactgccggtgggacccaaggcggtttcatcaccagcgctacggtcggcgaggtcagcgtggccaagctcgcgcccccggccaagaatggttggcagtggtggctgtccgggacgccttacggccaagagctttgggcgctcctcagcgtcaagtctgtgggcggattctatatcggcggccttccagagcgccgaggcttccggaaggttggagggacgttctggtgatccctggcgcgaatcttctgcgaatggccttcggggtcatcggcactcaaattgtgagatatcgcaagtttgagcagcgagtgaagaatgatcaagcccagtatgtctccatgttcggggagcctttcgacctggcagcgtctgtccagcgagtccgacgcgatcagtatgcccagtttaatctggagttccaacggaattatgttatgatcttcgccaactttgatatggttgacttggatcgcaatatggccggtgaccagttcctctggactggaagagtttttcagctggagtctcaaggctcctggttttatcaggacggctggggagtttgcctggccgtggatatcggtgcggccaagctcactgatgacgggaaaccgactttctaggtggtgtatgtttgacggcgaactgatagcgaaaatggttgtcgagctgaatgcggcgatggcatctgctcaagaggctttgcagttcccggattttgaagtcgtccagaaagctcagccgacccaacaggggacgtcaaccaggccgaccatctttttccagaaactgtttgacattcctcgcggctggcctgccaccgattggtacctggacaacacggcccgcaaatatgtggaaataactcgacagcatgtagagacgactttccagatcagttcccttcattggcagaatcctgaaatcactcacgtggttacggcttctgatatcgccaactatgtgagagcttatttccaagctcgatccacaattgagcgcgtaaaggaactggacttcctcattcttcgcgtgtctcaaatttccaacgaggcattcgagaacgacaatcaccagttcgaattccacccaagttttgacatggttgtaacttacaaccaatatattcgcctgtacgaaaacgcagcatattcggccgatggggtattaataggcatatgagtctgaggcgcgattcagagctaatcgccgcgcacctccagatgttaagagccatgcgcggcaggtccgtttcagccggatggtattccacggctcgatatcctgacaaggcgggcggatcggtcggaatacaagtcgcgagaatcgcgcgcctcaatgagtacggcggaactatcgaccatccgggcgggaccaggtatattagggacgccattgttcggggtcggtttgttggcgttcggttcgtcagaaacgattttccgggagaaaccgaggtaacaaaacctcacaggattacaatcccggctcgaccgtttatgcgatatgcttggaacttattttccgcagatcgcgccgcaatccagaatcgaatagccatgaggctggccagaggacaaatcacgccggatcaagcgcttgcccagatcggcctggcgttggaaggatacatagccagaagcataaggaccgggccatgggtggctaactcagcatctacggtcaggagaaagggtttcaacagaccgctggtcgatacggctcacatgctccagtcgattagcagcagagtaacataaaccaggagatcatccagtgatcagtcagagccgttatatccggatcatttccggcgtaggcgcaggcgctccggtcgcaggccgaaagctgattctgcgcgtcatgaccaccaacaacgtcattccgcctggaatcgtcatcgagttcgacaatgccaacgcggtgctgtcttacttcggcgcccagtctgaagaataccagcgcgctgcggcctatttcaagttcatcagcaagagcgtcaattccccgtccagcatcagcttcgctcgctgggtaaacaccgccatcgcgccgatggtagttggcgacaacctgccgaaaaacatcgccgatttcgccggcttttccgcaggcgttctgaccatcatggtcggcgcggctgagcaaaacatcactgccatcgatacgtccgccgcgacttccatggacaacgtggcgtcgatcatccagaccgaaatccgcaagaacaccgatccgcagttggcccaagccaccgtcacctggaatccgaacaccaaccagttcaccttggtcggcgctaccatcggcaccggcgttctggccgtggcgaaatcggccgatccgcaggacatgtccaccgcactcggctggtccacctccaacgtcgtgaacgtcgccggtcaggctgccgacctccccgacgcggccgtggccaagagcaccaatgtcagcaacaacttcggctcgttcctgttcgccggggcgaccctcgacaacgatcagatcaaggccgtgtcggcctggaacgcggctcagaacaaccagttcatctatacggttgcgacctctctggcgaatctcggcgctcttttcgacttggtgaagggcaactccggaaccgcgctgaacgttctgtctgcgactgcctccaacgacttcgttgagcagtgtcccagcgaaatcctggccgctaccaactatgacgagccgggcgcttcgcagaactacatgtactatcagttccctggtcgcaacatcaccgtgtccgacgataccgttgcgaacaccgtcgacaagagccggggcaactacatcggcgtcacccaggccaacggccaacagctcgcgttctaccagcgcggcattctgtgcggcggtccgaccgacgcggtggacatgaacgtctacgccaacgaaatctggctgaagtccgccatcgcccaggctcttctggatctgttcctgaacgtgaacgccgttccggccagcatggtcggcgaagcgatgactctggccgtcctccagccggttctggacaaggcgacttccaacggcactttcacctacggcaaggacatcagcgccgtccaacagcagtacatcacccaaatcaccggtgatcgtcgcgcctggcgtcaagtccaaaccttgggttattggatcaacatcaccttctccagctataccaacagcaacaccggcttgaccgagtggaaggccaactacaccctgatctattcgaagggcgacgcaatccgcttcgtcgaaggatcggatgtaatgatctaacggtttgcggcggactcgaccgccgcaaccttcaatgaatggagtgaggaataagcaatgatcaacatttctgcgttcggctcgattgcccaattcacggcaagcagaaccttcccgaacggattcaccgtgaccgagttcgctgatgatgcggaccccatcgacagcccgccgttcactgcggctgataccggcgtcggcctcaatggcgatatggtggtttggaaccgggccaacatcctggaagtcgtcgtcaacgtcatcccgaacaccgagggcgagcgcaacttggccgtcctgctggatgccaaccgcaccggaaaagacaagtcgggtgctcgtgatgtcatcggtctggtcgtggcgatgccggacggtagcaaaatcacctgtaccaacggcactcccatcgacggcgttctgatcaatgcggtggcgagcgttggccgcctgaagacgaagccgtatcgattccgtttcgagaaagtggtcaaagccggtactagctgatgaagaagattccgctgacagcagtcccgaatcaggcgatctcatttaacgccggcagcagctattggaagattcgtctgtaccagaatctggatatgatgaatgccgatatcagccgcgacggcgtgatcgtttgccatggggtccgctgcttcggcggaattccgcttctccagtatagtcatcagtatcgacccgactatggcaatttcgttttcgaccgtgacgccgattggacgttgttcggcgacggcataaacctgttctatctggacggtgtcgagttcgcagaatatcaggcgctggccacgaggaaagaatgagcacatcaacgatcagaaccggggcgaacaatgatatccttttggacgacaatggaaacatggtcattctcagggatgtagaggcgtgcgcccaggatgttcgggcggcgatgctcatgcgcaccggcgaaaacattttcgatgtgaacgccggcgttggatattttgaatatatcttctctccgcagaagagctatgatgacgctcgcaaatccatcgctgatgcgattttgtcatcgccggacgtgaccggcatcgagcaacttgacatcgacatcaccggtgaagtcttcggcgtcgatgcgaaagtcatcaccatccacgggcctgtaaccgcaggagtttgaaatgagtaccatccgcatccaatacgccaacggcacccaactgttcctggacggcaaaaatccgccgctcctggacccgctgccttctttcaacccgtcggtcgaagacctggaaggtctggaccgcgaaaagaacaccgacaagggcgactcctcgccggccggtcttcccgttcccccggtaaacgtcgattccaatgtcgacaacggcggaaccatcccggctccggtatcgaccgacgctcctgcggccgaatcggccccggaaggcgcccaggaagctcctgcagcgggccaaggcgacgagaaaggcgctgaggaagccccgactaccgccccagtagaaaaggccgaggaaacggcctcgccggccgctgaagaggaagccccggctcccgccaaggccacctctcgcaaaaccaccagcaagtaaggactcgacatgatcaacgtcagcggcttcggcacaggaattgtaatagtttccgcctcatcgttcccgatggggttttccttgtcgaagttcgctgatgatgagagtccgatatcatccaaagagctggagccgttcgggtatgagatgctttacgatggcggtctgtttgccttcgataaggcggcccctttggaagtgtccatatccgtaatcgcagggagcgaggatgatattaaccttcgcatccttctcaattccaaaaagggatcattccgatttcttccgggcatcatcccggatatgacgactctcgtggccactcttcctgatggcggccgcaccgttctgtccaatgggactatcatcaagggtccggccatcgacaccatacagaacaacggacgacgcaaaggcaacacgtacacttttgttttcggtagctatcttggcgcccagactgcgcgtcaagccatttctaacgttatccaatcggtactggaggtggtctgatgttggggattttcaccagcctcctaagttcgcgatctttttcgattgtggaccaaaacacaaaccagctagttgctgcggatttgaggataagccgggccaacacccggttttcttctgtagggcaacgccacatgctggaagatggtacgaccaagatggattccagaacgatccaccctatggaaatcatcgtcgaagtattttgcccttcaattgatgtcgtcgatcagatcaatcaattgctcctggatcgcgacacactgtacaaagtcatcactcgcggcatggtattcgaacggatgatgtgtaccagcgaagcgctcaatcagactccggatatgatatcggcgactcctgcgcggctgacattctcccaagttctcgtccagaatcccaagcctataatgttcagaaatgcaggggactcttctatgatcgaccgagggctggccctagctgaagacgtggttggctcggccggcgatctgttcgactacgcagtgaacggcgtccagaacgccgcagacttgttctgaggtgccaattgaactctttcctcaagtctattctcaacacgcctactctcaccatacgcgatgatgtcaccaaacttcctgtctggaagagtcttcaagtcaagaaagtggaaatttactcgccggcttccgtagtgtcgaaacctctggcgacgaaagaccagacggaagctcaagtgtacaccgaagctctggacattgatgtgaagaatggaaagatcatccaaccggtgcgactccgcatcaatgctatctgtccggacctgtccaccgttgaaagtatcatgaacgccttcaatgataacacctcgactttcgctatcacttctaagtcgatattggccgataaaatggccatcatggcgctcgatgtagatcagtctccagacatgttgaacgcggctgagatcaatatggaattcgagcaggttgagcctccagtattgaataaattcgatcctgcgttccctcaagatagtccgacttatggagtacagattcaatctctttctgatgctaatttgctggatttgggcgccatcggcgattcgatatcttcggccgcaaaatcgctatataatcgcgtgaccagctacttctgaggatgtatcatgcttgaaatcaatcttcccgatggccgtcaaactcgcgtacaaatcgaggcgtggtcggcattggatggctgggaactccagcgccgtttcgtcgaattcgctgtcagccaagattccgacttccgccgctctttcaccatggaaatcctgggctatgcgaaagtgctgcttggcgacgatgacaccggcattccgctgaccaccgcggcagtcatcaacaaccacctcggccactggaagaacgtggaactggttttcaactctgttctcaagcacaatggcatcgacccggccacgcacgccgaccggccggactattgggaacaagtcggatcgcagatggccatcgcatttctggccgaggcgtccaagctcattggtccagcaatgaagatcgccgaaggactcgccaacaagccggagtgattcatgtctagtgatttggatgaattcatacttcggtatgaggccgatactgccagagccgagcgcaatctggagcgcctccagaaccagatcaggcgcgtgaacagcgcatcgacgagtggccttcaggatttgcgccacttcgcagacggcgcggccactgaactcggccgagtcgttccgcagatcgattctgtgacgagcgcgattcgcgggatgaacgcgcaactggcgataggcgccactggcgtggccctggtcgcggccggcgtcaaggcgttcatgaacaccagggaccagtacaatcagcagcgcatccaggcgatggacatcggcatcgccccggcacgcttggaagagtaccagagaaaattcgttcgccagtccggtggaaccatcagccgcgagcagggcgcggagatgaccaaaaatctggcagacactttccggcgtgcttatcgcgatatcgggcgagtcggcccggaagcgcgaattctgcgtatggccggcgttgatgtcgggagcttccaaaagggcatgcggccgctcaacgacatcattactgatctggccacgaaaatggccaagctgaagccggacgaaatttctgcctacgctgatgcccttggcgtctcgcgagactacctgagcaccctggctaagatcggcccggccatgggaaaagtcaccgagatgacgactgcggaactccagtccagggtccagggcgagtccaacattcagaaattcaacgatgctctggcgaatctcaaccagacgttcaccaccctggaaaaccgagtcggcgaaaagctcgcgcctgcgttcaccaagctgatcgaaatcatcgacaagatagtccaggctattcccaatgaagtggaaagcttcgcgaaggacaccaaatcccgttgggaagatggagtgctcgggaaggcgaccgttggcagtgatatcctatccctcctcagccccggcgccctgctcggccgcctggcagcgtgggggactcgtcgcggcatggaagaatcagggctcatcgacaaggacaaggttcccggcgctcaaaccagcgaagacctggccaagaaacaagaagaccaggacaaggctactaagtccatgaaagagctagagaagctggctgaccagaccacgaagtctaccaatgattttgcggtggcgatcaacatgttcagtggcgcggtatcgtcgttcgcgaatgccgttgacgagcgccaagcttgggcagcctgggcgggggaaattggtcgggcggtcggtatgggaagcaccgcgccgacttcgcgggcaaccggcgtctatccgcacgcgatctatgatcagtcgaagagtggcgcggccggacaagtcttcggcgagccaatcggcgcccagtctcttcgcaatcgcatgttctcgccgcagcgcaaggcagagccggtcaccgttccatcgtacatcaacgatatcatcaaagatgcttcgaagatgtacaacattcctgagctggacatcaagaaactcatatacaccgaaagccgattcaacgccagggccaccagcgaagccggagcgaaaggcctcatgcaactgatgccggaaatcgccaaggcgtatggtatcactgacgtatatgaccctcgccagaacatcctcggcggaacgcgcctactgcgtgaaaacctagatcgagcaaatggcgacatgcggttggccttgacatactatcatggcggactcgatccgaagaactggggcccaaggactcgcgcatatccgggtttggtaatgagcgctccaatcgagctgatggaagaggctcagcgcaagcagaaggctgcggccatgaccgtcgccaacgagacgttcgccccggaaggcggcgacatggacattcgtccctgtgatggcgggcgactggaaaccccagaccagggcaagaaggaagatgagcgccgcgaagcccgtcgatatgacgacagggttgtgcgaccggaaattcgcatcatcgaccgcatgccagaccgcagcgacggcgaaatcctcaagatgtctagacgtcaagaggccgaccgggcagattctggattccggaagttcccgaatcaagttcgcggcgagaccaagcagaacatccaggctcaactcactgcaggagccatcgcgcaagtgatcggcgttaaccccaaccagatcatgcgccgcgaaatcagccgttctgacttgctgttcggatacaaccaagccatcctgggcaagcaacaggagatcaaggccgccgcgaccgaagccaacaacgtattcctgtctccagccaagcttgccgaagccacggccaaggtgaacgccgcatcgcgagaaatggatattctcaggacgtacggcgagcaacttctgaagagcgctccagagcgcggccaggagctgaccatcggtcgaatcgacatgttggtcaacgtcaccggcgcgaattctccggaagaggctcgtgagatattcagcaagcagactgcagaccagctgactacggcaatccaggacgctcaaaacgattccgcaactaagatactctactgatgaaaaagagaattctgcgagtaacattcaacatgccttatggacccgaagtcatccgcgaagatctggatgttcgggtccggattatgaaggctgcgttgcggattcagaaccgggcgacgatggaaattttcggcctcaccactcagctgcgcgagtctcttctgtcgcagttcaccgcgtggaagcaccggcagcgccaagtcggaatggaagacgagctgatgatcagagtatcggttgaggccggctattccgatcagggccgcgaacaagtttccagagtatttgtcggcgaagtggcaattgtcgatgtcatttcgccgccaccggatattggaattcgcatccagtgctacacaaggcaaatcgataggacgaagaccattcgaaatatgccgccagcccacacgacgtttgttaagtttgtcgaatggggcgcaaatgagatggggttgaacttcatctgcgataccagctacaatgatcaagttttgaagaatccgggccggtcgatcactgtcgcgtcggcaattctggcgtcaattcaggatatgtacatgccggatgtggctgcgttcgtcgatgatgacattttgatcgtgaaggatcgggacaaagtaattcgtccggatgaagtttccaacataaactcattcgtcggcatcccttcatggtcggaatggggcgtggaatttcagtgcctgtttgaaccgtcgattcgcgtggctggtggtgtcgcggtcgaatctctcatgaacccaagcgtcaacggcaactatgtaatcaccgctctagagtatgatttggccagccgggatcggccgttctatatcaaagttatggggagcccagcagcgtaatggccagggaaatcaaatcattcaacatgttcggcgtgcactacaactcgcggcaattctctgcggtcgatggactcaggatgatgtcgggaatccatgatgttcctccggaagaattgctcaaagggaccgacgtgttggcccatacggaggaacaaccggaaggtgtctggcttcccttgaccgctgcgaacataaatctttatgtcattgaccgggcgaacgtaatagctcccgtacaagtgcttgcgcttttatctgaactggtcatagattggaactttggcttcctcaaagattggacaggggtcaaaattccagccagatttgtcgaagatatcaaaagtgtgaaaacagcccattcaccttctgtggtcgcaagtttggtggcgaatgggtcagcttctatgcgcgagctggaagaatattattcgactcaagatgcctttaagatgattgacatcatgacggcgaagagcgtgaatgaggctctagcgtccgaagcatcacagaacagaatcaaaaagggatagttcctaagcgggcctgggaaggctatactagaccggccaaatcagaggctttcccatgtccaatattcctctaacatccgcaaaatctaccgacagaacgcgactgatcgccgctcttgacgctcggtcgcggcgggatgcgctcgactttgaagtcatgattcccgcccaggttgttcaatatgatcgggccgaaaatatcgctacaatccaacccctcatcacctgggtcgatacggaacacaatgccgtccagcggcatcagctggttgatatcccggtgatttccatgggcgctggcggcttccacataagtttcccgatccagcagggggatatcggctggatttacgcggccgaccgcgacacctcccagttcttggagtcgctatcgatgtcgaagccgaacaccggccgcatccacaaatttgagcatggtatgttcataccggacgtattccgccgatataccatcaattctgaagactcggcagcgatggtcatccaatcgactagtggagcgacccggatttccattcgcggcgacaacatcaagatcactgcgccgtcgaatgtcaccgtggatactccgcaggcgaatttcactggaagcgtgactatcgccaacaccctggttgtaaacggcgtcaacgtgaacaaccacggccacctcgaaaacaacccgcctgatgcccggacgaaaggcggcatgattgcctaaggagaatttcatggctagttttgatttttctgatttaacagcgggggggggttgtaatggctaattatgactacatagtagatactggagtcatagtcgccgatactgctgacgttttgaaagacgttgaagcggaattcagagcggccctcggcgccaatatcaacctggcagcctcaactccccaaggaactctggtcgcggccgagactattgcgcgttccagcgtaatgaggaatgaagctcgcatcgccaacaccatcaacccgaacgtgtctttcgggacgttcctggacgccatctgtgcgctgatggggatcgagcgcggctctgatctttcgacgttcggctatggcgtccaagtgaccggccgcagccagacccgaatttctaccgggtcgcgtgtgcagactccggccggagcgattttcacggtcatgagtgacgttctgattccggcaaccggagtcgccaccatcgacgtaaaatcgcaggactatggaaacatccctcttcccgtaggaaatctgatcatcatcgatggaaccatcggttgggccggggcgaaagtcatcgcttcaactcgcgtcgatcctggcagccgccaaatgaccgatgcagaactgaagaatgctcgcgtcaatcgtctggcgatccaaggtcgcaactcgactttggccattaaagcgtatgtcagcgccgtgcccaacgttacctcggtcaacgtcatcgaaaacaataccggcacggttcaagtcgtcaacggcgtatcattcactcttccgtatgcggtctgggtctgcgtcgccggaaatccggataagcaggccgtcgcagatgctctgtgggccgcccacaacggcggaactccctgggactatggctcggccaacaacggcgtcccggtggatgggcctactggcgttcctgttcgcgatccggcatctggtcgaaagtatgtcgtgaagtggactactccgatcatgtatgacggatatgtaaacgtcaccgttcagcaaggctcttcctcggtcgctccggaagcaatccagaacgcagttgtgaattacgcccaggggaaagtggagggcgaagagggattggtcgtcggcgcgagtctgtctgcctttgaagtggctggggctatcgctcgcgagattcccggcatctacatcaaactatgccaggtggcttgcgtcccggctggatcgccggccccggctcccggcgacttctcgcctgaatacgtcatgagcgcattcggtcaggctaccatttcggttggtaacgttagggtgactttcgtatgactctgcctgcgtacaattctgatattcaacaggcgctgaagtggctccaaaaccaggcccctgggatcaccggcttggttcagcgaaaggctcaatggtatgatcgtttcagccgtcagttttgggtgaactgggagcgcgacgttttcaacttgaagaccgccaacccgttcggccttatggtttggtgcatcatcctcggcacgccttcgaaagggttcggcctgtatccaaaaaacagttcttgggcattcggtcggctacgccagaacttcatctatagcggtacacaagttccgccaccggcagacgcatcgccgggcggcaacttctacggtggcggcaatgccgaaattctcaacttggacgaaatcagaaaagtgcttcagctaagatatgtagcgctgatttcgaacggctcgattgcatatatcaatcgcatgcttcgctacatattcaatgatgatgagccgtgggacgaggcgaccggtctgtacttctatctcatggactcgaccggcgagaatggccctgtggagaacttggccatatatcggaaagattgggaaggtatggtattgttgtccagttcgcccagaacgaaccacgtgctgacatcgacccctgccagcgacgccgattggccgggagtcgatccggccgcgagcggtcttccggtaacggtcgaaacggcgtccgctacggccccggacggctccgctacggtgtgcaagcttactaagccggccgggagtaccgcttacgtctccgcgccgatagatgggccgctggggtccggtagcactgtaacgttctcgttcttcgcgaaagccggctccacccgtttcattgcaattcagtcggctgccgatttccccagtcgagccgatgccgttttcgacctggattccgggaacgtgatcagcgatcagatgttggacagcagcgtggtaagcgcccgaatgattcgtctggaaaatggctggtggcgttgcgttctcacgaccaagaccgtcagctcttcgttccgcgctgcttacgtagctcctgcagaaaccaacttcagctggattgattcgaattccagcgcggcgattgacgtgcttatctggggcgctcagatcgaactgggtgatactccaactggatacttggagactaccggggcgcccgtgaccatcaccgattatgctttgcagaacgcccagaccggaacagtcaagttcacgcagccccttccgacaggagtagaagcgtattggactggagactggaaaggcgggtctgcgaccgagccggccagattcgcagtaggggatgggactcaagatacattcaatctgtccagccctgcatacatcggcctacccactagtggggcgttcaagctagaatacagagttggtccggcgcttaatttgtcgccgcaattgatcaacctcatgaatgaccgggcggtcggtatcatgccgacttgcgccggttgcgatgtaaaagtcattcaggagtaatgacgtgatcacacccgaactgatacccagtccgtttgctgcgcagggcgacaaagacccgatcccgcagacctcttccactggttttgccaaccttcgcgatggctacacgccggactacgaaatcagtctggcgtcgaacaacccgcaggccaaagcggtcgagcggaaaattcaaaaccaactcttcttcatcgcgacccagaacgcacaggcgtggcagcgacaaatggcgccgccgtggtttcagggcatgcctggcggctacgaacagaatgcagaagtcgtgcgcgtcggaaatgacggcataatgcggcgttatcgctccatggtgaatgccaatgcgagcgaccctctcagcagcacgacttgggaagaacaacccgcatggtcggtgatgcgctccaacatcccgatgccggccggaggcccaggcctatcttctggcggagaagtcatcacgaccggccgcaacttcaacgacctgttaaatgggacgtgggagttcttctctgattcagtggttatcgcttctcagaatgcccccgtatatccggcttccgctggtgccgctgctggcatgttggaggcgaaatcttgggtgtccggagccaatacgttctgcgtccaacgctacactgatcgcgtcgggaacgtcgctgtgcgcgggcttaatgccggagcgtggaccaactggatgtatgcggtaaacgtcatggcccttcaacaaggtcgggtcacctatggagtcgcggccggatctgcgaacgcttacacgttgacgctagttccgcagctccaaggcggcctggtggacggcatgattcttcgtgtcaagttcaacaccatgaacaccggcgcctccaccatcaacgtctccggatttggcgccaaggccatcgtcggcgcagcgaacttcccgttgaccggcggagaactcggtcaaggcctcatcgctgagcttgtattcgacgccaccggcgaccgctggaggattctcgcaggcgcgccacgcatccaagtaggcaacgccgatcaagattatcaggccccaagctggaaacaggtgaaggattacgtcgcgtcccaaaagctgactgaagtggactgggctgacgtcgtcaacaagccgaacgtcgctatccaagacactacgccgtggttcgccaatctggagttgtctgacgctcggcctttcatcgatttccacttcaacaacaaccgcgccaaagacttcgactatcgctttatctctgaagctgatgggtcgatggcgttctattctcgccaggggtccgctggtcctacccaggatatcctgttcagcaggtcgaatgttacattcctccagccgcgactggatgttgcgaaaaacctcgcgtacatcgcgaactctggccccctttggcagaacaccactgccgatcagcctggttggaaattcaccttcgcacaaggcgtggacgccaacaacaacgcggtgatcgcagtcaataccaccaatcctgacggctcttatcgctcgcaaatcatgcgatgggactgggcgtccacgaacgtcatattcaacaatcgccctctgtttgctggacaatatgttccgtgggactccggaaactttgatccggccaccaagctcactgtcgggactaccaacaacatttcgcggccgaccggaattcgcaataccactagcaataccggaaatatgaacacctggggctccagctccacaactgcatcgtatggaaacgcagcccttcaaatcttcggtagagggggcggcgagcctgcggccatctacttcgacaactcccaaaccggctggtatttgggcatggacaaggacggccagctgaagcgagcaggctggtcgctcggcaataactcctatgtggtcactgacgagtcgaatattcgtttccacgtgaattctatggctggcactccagtatggggcggaaacgaattctgggggccgtggaacttcaatccgaacaccaagttgaccatcaaagccggcacgcaggaaactagcagcactgcgatattcagcggaaccatgccgttcgccccaatcgcgtctctgtccgactattcccaggcgccattgacggtttacaactcgccgactggtccatctgctaagcctgccgttatcgcgttcattcgccctggaaactggggcgcgttcttcggcatcgataccgacaacaagctgaaatggggcggcggatcgctcggcaacagctccagggaaatcgccgattccagcaacatcatgaatctttgggcggccaacccgaccgcgccgacctggaatggccaaaccatttggcgatccgggaactttgatccggcaacgaaggtggatttgaacgccgcgaacgccaccaacggaaacatgatcttcaaccgcatcgccggaactggcagcgggatcgcctcttccgaccgcgtcggcgcaatcagcctccagaacggcgcaacggcaggcgcggccgcagcagtaacattcgagcggggcggtggtttcttcgtcaacttcggcttggacaccgacaacgttctcaaagtaggtggcggaaacctgggggcaaacgcctatccggtcatccacgccgggaactacaataactacatcaaccaggcgctggttcaggtaggtcttggcggagtcggttcctatggcattttcgcggttctggactatgccgctccaaccgcgaccgttcaaccaggagtgattgtggacggctccattctcatctactcgtcttgctccgcacactacaatagcggtcaaagacctgccggaacttggcgctgcatgggctatgtactcaaccgggacgccagagaccctgactccgcgacccttttccagcgagtgacgtgaaatgaaatggacgcggatcagaaacccacgttggctggacgcagtaaacatccacgccatggtgactttcgagggaatcggtgaagtgccgttcaccgccaatccgcaagacgttgaggcccacggaagggccatctacgctgcgattctatctggggagcacgggcctatcgccccggtcgattcgaagcgggagaaggccttgcaggacgctatacgagccagggaaaagcgggctatccttcgggatacccgctggcccatagatcgccacgacgagcagagacggctgggtatcgaaaccacggacggccctgggctgatcgcagcccttgttcactggaggcagcagattcgcgactggaacagcggggatcggccgcgacttcccatggctctgaaaacaatgttcaaaaatcaggagtactgatgaaaataacgaaggatattttgatcaccggaaccgggtgtaccatggatcgggcgatcaagtggctggatgacgtccaggcggccatggataagttccacatcgagtcgccgcgagccattgcggcctacctcgccaacatcggcgtcgagtccggtggattggtgagtctggtggagaatctcaactacagcgcccaaggactggccaacacttggccgcgccggtacgcagtggacccgcgcgtccgtccgtatgtgccgaacgctctggcgaaccgcctagcccgcaatccggtcgccatcgccaacaacgtgtacgcggatcgcatgggtaatggctgcgagcaggacggggacggctggaagtatcgcggtcgcggcctgatccagctgaccgggaaatcgaactatgccctgttcgccgaagactccggtatggacgttctggagaagccggagctgctggaaactccggccggcgcgtcgatgtcttcggcatggttcttctggcgcaatcgctgcatccccatggcggaatccaacaacttctccatggtcgtgaagaccatcaacggcgccgcgccgaacgatgcgaaccacggtcaactccggataaaccgctatgtgaagaccgtcgccgcgatcaatcaaggctcctgatcttctccgaaaagaaaaggccgcttattcagcggcctttttgctttccggctttgcctcttcaatcttcctgacttcaataggcgcggcagactcttcctgggtgaccgagtccacatagttccctagcgaactcagaacgccgatcaacagcgctcttaccaccttgtccttgactgtctcgcctatgatctttgtcagaacggatatcaactcttcccggagtcttgggctgattcttggccgaaagcgcttgcgatgctctttgcgtttcatgtttagtcctctgtctgcggtcttctcctcaccccgataatggcttggggatgcgctgtgttagtcggaagggtcgggcgctattataacccgtcgaaaatgctcgcgcttaactgtttaacgatacgcaccgcgatactaaatcgccttctttctggccaaggaactctggcggcctggtccggtctaaggcctaatttgtcgacattaaaacgaaataaacccggatcgcctgtaggacaaggcgtccgggtttatttcgatctagtgtccgctagaatcagtggctcgcgccccatccgtccaaccagcagtcgaagacggcatggcgcggcttatccttcgcaccatgcgggaaatgcgtgaatcggatgacctgaccattgagggattctctgtccttccagagacgctgcttttcatcgtgagtgatgctggatgccgaaaccctgaatgtctgcccaggccaaactttttcgttgcggcagacgaacgaaccgaccatgccggacggaacaagattttctgcgtggctggaacgggcagtgtagccaagctcatcgatgaaggcttcgttttcgttgatcatcaactcttcgacgccgatagtttcggcctcttcggaatcgtacctcttgaacttcacacaatggccttctttcgcggtcgagcgaccgaacttgtaaattccattcttcttcttaccaatggaaccttcgaagcccaggccgacgtgccgcagctccgcctcggtcatctgttcaacggacgtaaccagctcctgctcgaccaggtggatgcgggtcatttcgaagcgttcccggagttccttgacccgatgctcggccgcgtcgaggcgttcgtcagtcggcattctgggatcggtgaaatcgtcgaacacgtggaacgaccagtccggttcgccatcgcggcggcgaagatcgccggacgatttctgaaagactttcgggtcggttatgtcgccgcagaccaactcgccgtccaggccgttgaaaatcggattgctgaggtattgattgatggccgcgttcgcctgcggcttgaatgatcgggtcagagcgtggccatcgtggatgaaggcgcgaaagccatcgatcttcggcgacatgaagattggcagttggccttccagcagaccgggatcggccatcgatgcgaacatcggtttcatagaattctccagaaagaagcccggcgaaccgggctgaatggcggtaagccggatcagatggtttcgttggcgtgattcagctcggccatgatcgatgcatagcgctcatccgactccttgatgaacacgccgttgtacatcacgcctttgcgatccttgatggtgtcgtaggccgcctggtagcattcgagcatgctggtgtcatgctcttctgccgcgtcgaacagggatgcgactgccatgaccaaactcttgatggcaagccaccgattcccgcgagccagcgagccggccaggtcgccgagcaatttcagatcttcgccgtaggacgggcgacgctcgaccgccaagacgaaggctgacatatggtcgaacagattttcgccgagctgcgcggccatgatggtggccacgaccatgacatcgccgatgccgtctttcacttcggcggtgttattctggatgtaggcttcgcaaacttctgcgaattcttctaccagcttgaggaactgatctttggccgaagagcctttgatcaggttacggtctgaaccccattttaccaccaggtcatggagttcgctattcatgattcgttcgatgatcattctttcgattccttctgtatttgggatttgactgcgttgatgatggacgccgtgctctggcgcgatccgtccttagtggtgccgaagtaaaaggccataacagacttcagttcggcaaaccaatagccgatgatggtgccgatggcgacggaagaagtcgggtccatcagcgcctcgcggccgaatgtgaaaattgcgatgatgatgagaatggaaccggtcagaagagcaaaagttatcgccgggcgaacgaagtcattttgttgcgcagcaagccttctcgccgaatccctgtctgccgcctcggcggcgaactggctgagttcggcttggagctggttttgctcagactgaagacggttttgttcggcctggatggccagctcctggaggcgaacgcgctcggcgctctggagttctgcgaggcgcgctagagcctccggattcgcgtctagagcgctcgcgaccgaggctgggtcggccttcgaccctagcgccgtcgcgacgatagcgccaacggcggcgcctgcaggaccacccaggagcgaccccagggccggagcggccgcgccgatcttactacctatgtccttccagtccatatttcgattcctcaaaagaaaggcgccattacagcgcctttctctggccgttgacgttagaactcttcggcttcagtggcatcgcccacgccaccggcgtcgccgcgcggctgttcctgcttgctgtagtccaccttcacctcaccgccgacgaacgacttgtacagatcggcggccgccttgaagtgatccgggtttttcaccaggccttccagttcgaactggacgccggaccagctgcccttgtcgttcgacatgccgacagtggtcatacggaccaggttggcgaaagtcggcggcgtgcgcaggccctgcggagtctgaactttcttctgggacagagcggtcatgagcttcttcgaggccttgatctgcgaagacgacagggagatcagggcctggccgaagtcgccggtttccggatcgatgacgatgacgtaatgaccacgggtgtcggcgaagtaatccgatttcttgtcactgaccgagccgtcttcgttcggcgcgtacaggcgcccttcgacttccttgaccttggtagggtctttcatcatttccttgaagtcttcgacgctgatggaccctttgaaaccgccctcggcctcgcgaccagcccagcggatgaactcgcgacgatacgcggccgggatgatcagcagaccggtcttgccgtcgtaaatcttgccggtgacggtattcaggaacatgccggccttcgcgccctcgatgtacttcggatcgtcttcatcgacctgcggcgacatcttttgcagcacttggatgaagggaatggcataggaatctgcgtcagccccttcgaaaccggcgccgtcatacgcgtacaggtccatgaagtcgggaacgtcagtagtcgcgacggcgccgccgttggccactgcaacggccttggtttcttcagttgcttcggaagtctcggttttcttgccagccatgttaggctccttgtttgtcgaatttcagttatttctaactgtgggtttataataacgtaagttgcaactaagtaaagcaaattacatattaagctttgctctttttcaccttcggcttcgtgatcttggcctctttatattcgtggacgccgatgaaatctggcaactcttcgcccttctccaggtactcgcgaccgaacgcctggagggtctggtagtgaacatcgcggttgatggtggcgtcatagccggcttcgatgatcgcttcggccgccttcttcgcatcttccatttcgccgcgaccgaattctgccagaactttggtcttgatgatgccgtcgttgtctgtgtcttccagccacttccagaacttcgacttgttctcttccttgacggaaatgatggctttcggctcgacttttaccgtgcggccatcagccaaagtcgtggtcttctggccgagttcctccagaagctcaggaatggtgttgcgcttgagggtcttcagctcttcctctttttcggccagcgccttttgtaaatcgaggatttcgccgtccagctgagacgccttgtccaccaagttcagcagtcgatggccaatgtcggtagcttcgactgccatttcatccatgacgccgaaatagtcaatttcgcccggcgcattgtccttcagatactccggaacttccaattcttgctcgctcatgtcagcctccaacttagtgatgttcccttacttgaactaagtattgagtagatattatgccgcatcttccttgatacggctactgatttacatattaaatttcgtcgcgagtgctaacgtcagcctcgaacactccatcaacgacataactcgcgagattgcgcttccactccaaactagtctggattttctcgtcgatggagtccaggcagatgaggtcgaagtacagaacagagttgacggtcccgatgcgatggttcctgtcttcggactgcatccgcaactcgttgtcttcgtcggtcgtgtagtaaattgccacgtctgcggccgtgagcgtgatcccgatccctgctgcggccgggttgcccaggaacacctggacgcgcttggcctggaaatcgtcgatcaatttttcccgctcggcctctttggtctcgccgtagtatgtgccaaacgaaattccttgggcctccagatacgccttgatctggtcgatttcctgaatgcgcatggcccagatgatgatggagcgctcctggtcttcctccagcagaccctccagaagatcagtaaacacggcgaatcgcgggttgtcttcgggcggcaggatcaccggctcaccatagacgttgatatagccggacgcaacttgcttgagcttcgaacgcgctgccgcagcatcgaaagatacatccagcatgaaatcttcgttctggagaacgaagtgatagtcttcttccactcgctgataaaccttcctttgctcaggcgacatttcgaaatatatgcgcttgtaaaccttttctggcaggaatggtaatgcttccttcttcgtgacccggaagctgtgcggctcgatcagggatcgcagcttgtccaggttccggaataccgggcgcccataatcgtctttttcgacgagttgcggcggcatggtttgcttcccttccagcttgcgcatgatagcgatcattcgaggatcgtcactgggcaccaagacggaaaattcggccacaaacgcccgataggatttagtccccagaattccattccgcaagaattggaactgcatgaacaaatcggtcggtgcccgcgtcagaggagttccggaaaggatgcgacgggccacggccttctcgcccagctttactatctttttcgcacgcttggcttgtgggtttttgatcctcgttgactcgtccacaattgcgcaaactttgaatgtatcaaggaatcgctcgacctcatcatagccagcctggtggttgattgcgtcaacgttgatggcgaagacgcgaagaactttttcatctgcgaacgtctcggaatacagacggtccaagcgcgccctggcctttttggaagtcggtcggccgcgccaatccacgcacagggtcttgactgcgacgtgagtaggaatttcgcgcagaatccagttggtatgtacgcctttgggggcgacgataagcagcgcgtcaacccttccttgcaggaagagcctaactgagtctgccaaagtagtccaggtcttcccggtgccctgctccatcaggtatgcgaaattccttttgttaagggaagcttccagggcattgaactggtgttgcatcgcctcggtcttcatacccttgacgggatatgttttggctttcatttgttctccaaatcggcgaggaactgaacaatgttatccagtccttctgcatagctcgcaacttccaccaagtcgcggctgttaagctcgaacaaatcgaacataggattcagcagcagccaatcggttccgatcttggccaggacgaagccccggccaccccagccgatccgctcccgaagaaaagggatttgcccaggttcgaaacatctggccattgggcaggtggaagcgcgtttcggccactcctccaaagccttgaactcgacccagaactggacacctcgacgattcaggcagatcgaatcggacatgccagaccgccgcgtctccagaaagtcgatcaggattcggccgagcgagcgctgcttaaacgcattcgccgctttcgtttcgcgatcattcatcaccttcgccctctttggaaactttctctgcttgcgctgccaactttgaattctcgcgctcggtcaatatccgcttgacggccttcacgatgaacatgtctatgccgcttagcctccatcctttgatcaggaaccaagcgccggtcggcgtcccttcagcaatctgctttccgtattgcagatatttttcaggccgaattctgaaacgtatcggctgatcaaccgagtcatcaacgcacatgatgtcgagaaactgcgactggcccttgtacaccgggtttttcccttgatcagccctcttcttctggcgaatcggttcgttctcatcagacagaacttttttcaccatcttgacaatgaccagaccatcatctccatcgcggatatcccgaatgttctgaatggggtttccggaagttactccaaccagctccggattgtcataagcatgaccccagagcgtgtgagcttcgttcaaatctgcgaattgaacttcagaattcgacagactcgcggcgactttctcccaatcctgaagcgtcttcaggtgggtgcctgccagctctttatattgagccttcagctccttaagatcggccttcaactccttcagatcggccttcaacagtttctccagttctttgtcttggctgattttcgccgaaagaatctgggcttccagagctgctacatcagcagccttgtcctcaacatcctgtgccgatatcgggcaattggccagggcgatcctcgcggccttgacttcctcgcgaagacgcaggaaccgctcggccttcgccgggccgaagcctttggcgttcatgatgccgccgatcaagcgtccatccgccactacccagttaagttcggaatgctccgggtccagggccgtatattctacgccttccttggccaattcgcgaagtatggacacagtttgctggtcgtctttcgccgcccgaagacacgcggccgcgtattccaggcgatgatatcgcttcatgtagcaggtccagtacgtcaccacagcgtagctgaccgagtgggagcggttgaatccccaggcgccgaacgttaccatttcctgccaaacacggttagcatcgtccggggcgacgcctatggtcttggcgccctcgatgaacaattcccggcgcttgttgaaaaattcttcgccctttcgcgcagacatggctttcctgattgccgatgtctgctcccagtcgaactgcccaatgtccttcacaatggacatgatctgttcttggtacaggaaaactccatatgttccagacagatactgctcgacctgcgggatggtataggtcacaggctcgcgaccggccacgcgctcgatgtatttggtggccatgcccgaagacaacgggcctggacgggcgagcgccgttatgtggtcgatgttttcgaacgcggtgatattgatcgcattggcgaccgagcggacggcctggccttcgaactggaagatgccggacatcttgtcttcgttgagaatgtccagaaccgccttgtcgttcaacggcaagtcgtacagctcttgcgccgtcacgcaattagcatcttggatgacgcccagagttcgaagcccgagcgcatcgatcttgagaagattcagatattctgaatctggcttgtcgagctgcgcgacaccttcagaagttaccgtgcagaagtcgatcacttcatcgttgcagaccaggatgcctgccgcgtggacgccggagtgggatgggtggatttcgaggtcgcccatgcaggcggacgcaatctcatacttttcacggaagtcgcggccgggctgagttttttcgaaagtatcctccaatccttttccatatcgttcgtccgccgatgtatattcgatgatcgagtttttgatgttgtcggtgtcgtggaatggaatgccgaagcgttttccgacgtgagcgataaccgacgcggccttgagtgtgttgatgttcccaagctttaccacgttccaagtgccgtatttctgctggagatattcgaacactaaatagcgatgggtatcggcaaagtcgatatctatatcgggaagatcggaacgggaaatgtcgataaagcgctggaagagaaggcgatgcgggagcgggtcaacctcggtaatgcccaggaggtagcagaccaaagagccggctgaagagccgcgagccgggccgaccagcatatgcttcttggcgaacgcaaccagatcggcgaccaccagaaagtagctgtcgaaatctttcagctgaatctgcttgatctcttcttggaatcgatcctcatactcctgggtccattccttgatgtggccgcgactgagacggtaggcttgcccctcgcgagccagcgcgacgatatccccatccaggtggatcatcggcgccttcgccagtttcacatccgccaactgctcgactaccgcacgagtattggcgatggcggaatcgaactcttcgcgagtcatgatgtggcgtaaacggctccacagctcctcttcggtggcgatgtggcgaaggccgaccgattcccgcaccttccaggccgacgcgaaatcagcatggtcgatggacggcatgtcgttgtaagaggtaattaccaccggctttccgaatgccctggccgtctccatagcgccgtgcgcggcgaccatcgacgcgggattgatgtcaatgtagtcgattccggccagatccagatgggcataggcctcgccagcgaatttgatgacgccgtcagcttcctggaattcttgcggagtcaatccttgattctggaccgacttggaagtcaagcggtagaacttcttggtgtccttggcgagcacccaggctttgagcttcagctctttctcgccatcgtcggcgcatttgatcgggatttccatgccgaatccgcgaggcagttctgccttggtagcggcttgttcccaacggacgtggccccatgttccatcatcgacgatggcgacgaatggggattcgatctctttggcgcgctcgatgatctccgggaatcgaccatatgcggcgccgtaggagtaaccagagcgaacgcggagttgagggaaagacattatgcggcctccattgcttgatacgccccatacactcccatgcgcttgcagacttcgttgagcagccgcacgtcgtcgagcgcccggtgtttctgtacatatgggccgcagtagtgctcataaagatgttgcaaccgcatgcggtggccgaacaacggcgccgactcttccacagtacagatatcgagtgatgggaaattgacttcttccaggccgagctttccgcgagccaaatcgcaggtaagcatgaacttatcgaatggcaggttgtgggcaatattcgcgtcggctctggcaaagaagtcgcgaactttttggcgctgatcgaggaaagatgggtgcttgatcaggtcttcgttcttcaacccggtgatcttggtgatgatttcctcgatgacgattccaggattgcagatgaactctacttcatccaaaatcttttcgccatcagttatcacgccggcgaattcgatgattctcggctgctttctcagactcaccctttggtggaacgggagtcctgtggtctcagtatcccatacagcgaatatcatgtttgttccctcttatgtcgaaaggccggctgctttcgcgaccggcctgaggagtataccgcgacggctgaagatttacgccttctgtccgtctttcggcgtgatgcggccggagcgcatggtggcgtgaacaaacgccgaatagttgatcgagtccaaggccgaatcggcatccttgaacccgctattcgccaggcgagtgagtttacccaccatgtgcatcacgaacagggcgagtcgatgatcatcggcggtcttcgccaccaggccgttcgggaagaggatttccatgatctttccgtacatcagatcattgcgaccataggtgctctggcgggcgcggaagacttctgctgcggcgtacagattgttgagaacatcttccgcgaaatcatctggatgggaatcatcttcgcccggccagacggattccatggcgaacggcgcggcgtcttcggtcgggtcttcggactgagccgtttccgcgagcggagacggggctttcgcaaacgcctcgtcgagggtaggggcggagttcggggcggccgggaacggctcgcctgccatgtcgttgggcgcgctatcggggtcgctatcggccgcgacggcgaagaacggcgcagcgcaaccttccaggttcaggatgtaggagtcgatccccaggctattgtaggcatcgatgatgtcctggcgatcatcgaacgccgcgacgatcttggtgacgccttcgattttcttcaggatgtcgagcgcgactgcccgcttgaactgaggcgctggctcggtgttaccatacggccgcatgatgagttcatactcgcgatgttcggcgatgccgagttcgcggtggagcttggccctggtctggaaaaagtggttgtcggttcggccggtgacgaagaaaatcatgaggtcggcgtcgatggcattcctgatgcgacctacagcgtgcgggttgagagtgtccttgtcgagacgagaatgatactcgtcccattgccgttccaaggcgaagctcttgcggtggctatcgtcgaatacgcagccgtccaggtcgaagatgatgatgccattctttggtttgcgttccatattcagatttccttactggttgctttctgggtgacggttttatcgatgaacgtcccatcagaagtgaggcggaaaacttcgccattctggatgaaatcgaacgattgcacgttcatcgtgatgcgaatggattcgctgccgttggtcacttcgacttgtgcgacgtcaccaaccttctcgatgatgatcttcatgctacattgacttcccattgacggccacagggttggcctcttgtttctccgatccccagaaatcgcggcgcagttcttcctgctcggccgagcgatccatccaggggcgatagaacttgcactggtagataggttccaacggaacatcaaccacaggaatctgacctggctttgtctccagagcggccatgaaccggtcataggatttctgctggatttcctcttcattcatcatcttcgacccatagcgcgggaaggcgcaggaaccggtggcgacgcagtgcggctggagtaggctgtcgaacatcggatagacttccagaaccagccggcgcatctcgcggaacacttcctggtattcaccctgggtccgaacgcacaggcgaaccttcgccatgtcgctgagagtccgcagattgaacttggccgcgatcttcgtttccatgttggaaggaatgattgcacgagcgtcctggagcgacgcgccggcctccagcagcttctggtaactggtctgcgcgtcggctatggcatcatgccacaggcggttcagctcttcgcgggcgtggtaggtcgggtcaggctcgccatttaccgtagccggttcgtcgaattcccagcggaatgcttccggctgaacgacggcgctgatttccagagcgcgactggtttcctgctggtaagccccggtacgagtccgaaccagttgatgggtgaaattcttgctgacaccctcgatctggaagatgaagtccacgaactcgaacggcgagcggatggtgtccagcatgtacttccagtggtcgagcttttcggcctcggtcatggtcgccgggtcttggccgcgcatgcgggtggacttcgttcccaagagcaattcccaggcgttctgggtgtaactgatcagagaaatcttcatcagaaatcttccggaattggcgtgaagtggaatttttcggtgagagccagggccaggccttgggcttgctctttacgaaggccatactgctctatctcttccttgagcagttcgcatgcctccagacgcgactcatactcttcagcctcctgagcggatgagaagacggttccatcagaggttctgtacacaagttcaatcggcatgatgacctcagtagcagcggatgatttcggcgcggatatctcgacggtcgaggtagtgctcacgaatcttatcgctggcgcgctcggcctcttcgcggctgccgaatgacaggttgaacgacgtgaaaggcttatcgtccagttcagcgccggtctgatacaggatgcctaccagaacgaaagacggcgcggtcttctgctgctggtcggcttgcatttcgaggaaggacataggaacctcttcagaatgatctggtgcgtaaattaatagcgctcctgctgagcagctacggtttccggctcgtagatgagcatgtcaacgatttccgggtactggcctttcacccagtcgatggccgcgaccagtgtggtggaagcggagaaagagaaagtgcggtaagactcatggatgtacggcgaccccatggaatcgcgctcggtcgtgcgcgaaatgactgctttgatattaacgatccggcccatcttcggcctccactttagcgattatatcggacaggcttaacttctcgccattcaggaaataactggcgcgaaacttcctgtcgccctctggcccgacgattcgggccgttatggtgagactcccgccgccaagggcatcggtgtcccggaagaaagctagcagcgcccgcttgagcgctgcttcgcgaggatcgacggccattaacctaccacgttccagccgtgctgagcgcaccacacggcaccggcccctgcaggaagactattcagaaggaacacaggagtcaggcggccatcctcggtcatatggacgaagtagcgggcgccttcaccgagccactcggccttggcgatggcacgttcgagattggccttggtggcgtaggtcttggtgtggttcttgtcggtggagaaggttacttcgcgggccatttgtcgattccttttggttgaagggtttcgcgtttcgatgagggaatattacgcccacctgatccagaagtaaagcacttttgtaaattacttcacgaacattttcttggccttctgataagacgaagaagtcatcaggcgctcgatgacgtccatgtccgaaaccagatcgtccagaaggacgtttcgccaggtcgcgaaccgaccgagcgagaagatgccggcttcatgggtgagattccagatcatggattcgcgctcgtcgcgaccgagcggaatgattttacccttggtctggacggtcggctcgccgtccggaatgagattcttcttcctgatgccgaaggccgcgcaaacgtaatccatatcccagtcgctgtcccattcgatggtttcgattttaccatctaaagtctccactatcccattagtgatggattcgacgatcagagtatcaccggtgatggacgctcgaaacgttcccactttaggaccagggaaatacacggtctggaagacatcacaggggatggaaagcttgtatcgactcacgatgatggaggttccttcaccgaatgacgggtcgattcccaggtccagccctgccgcagccagattggcgcggaacggcgcggtgctgatgatattcacgtggtcatcttgccggcgaagatactggaagaaagaggcgtcgaaaggacggctccaagtgatacgattcgcaagcttagccaccagctgctcatagtagtcggccggtgcgatccaacgcttttcagtcgacagattccagatggaccggtccgacaggccgcccgttactttcctggagtacatgttgcagtggtcgatgcgcggctgggaaatgaactcgccgtcgatgtagatagctttgtgcacagtgacttcgcggaacgggatgccggtgagttggccaatcactggcgagcggaatcgcagaagtgcgttgtggcgttccttattctccggcgtcgccgcgtcgatgatttgggcttgaggaaagcgatgcgcggcgatcagtccggcgagtccggcacctacgatgattactttctgatcaggaatcatgatgtgtcccttatgagtgtacaaaacttgagaggataaaaaagggacccattttcatgagtcccttgaagagctagacgattcaggctcagaggagcggcggcttactcctcctcaccttcggaaccatcggcgccctgatcttcaccgccgtgctcctggccttcgtcatcggccttctcgtcatcgccctggccagcttcgtcttccttcgaagcgatggcaaccagatcgacccagcccatgatttccagcttgctcaggtagctgcggaccgaagtgccatagagcagatgggccaccttctcgccgaaggattcgatttcgaccggctcaccaacggtacagtgctcgttgatgtatgcgaacaccttgccgcgagtcgagaaggcctgcggagtgccatggccgtcgccggtcgggatgaagtgggtggcacgcggacggcgggagccatttgacttcaggtcttcgcggcgggcttcggccttcgcgcggcgctcttcctgctcttccttgcggcgctgcttctcggcttcgcgctctgccttcttctgctcggccaggcgcttgcgctcttcttcgcgtgcggctttctgggcttcctgcgcggccttcttctcttcggccttctcggcctgctcggcttccttctcggccttcttctgctcgcgctcggcttccttcgccttcgccttctcggcctgctcggcttccttggccttcgccttctcagcgcgctcggcttccttggcggcggccttttccttcgccttctcggcgcgctcggcttccttcttctcgcgctcggccttgcgcttctcttcgcgctcggctttcttctgctcggcttccttggccttggcttcggccttctcggcgcgctcgcgctctttacgttgacgctcagcggccttctcggccttgcgcagggcggctgcttgttccttggtcagctcttcgccttgggtctgttcgttctggtccatgttcttactccgggaatgtttgaaaggatggcttattggcctgtgagaggattatctctaaactaattgaagaagggaatacctttcgcctgaacttctctaaatatttttctttcgggaaagtccagactccagggaacttatttatgttagcgaagtttttaactcttacgcaaaaacaacaagtattcaattgcgcgagttatgccagtatacatcaactggctgtaaggaattgaaggcaagttttcttccaacattgcgacccgcttccattccgatccctgcgacttgtggaacgtcatcgcccagccgaagtcgaatccgccaatggccttctgtgcctccagccgcacatcttcctcaaccgaaaagctaagaggattgaacttcacccagcgctcatagttcgtgccgataatgcgaactttggcaaacagcatttcatccggctcgtcatcatcttcttggccttcggggaccggcttgaagtccagcagaattgcttgctcgccgttcatgatgccatattcgtgctggttcccggtgcacaccagcttctcgccgatttccggttgtacacccttgtagccgaggatgcggcgcgccctggcgttcaaacggcggcgagtattgttgtaggcgcaaaggatcacgccatcatcgtccaagaacgtccgcatttcgtcgtccgacatgtcgaatccggcccgtaccaggatgtcgtcatactcgcggcagggcaggcgcttgccctggcggacgaacatcgacgcccgaacgatattgccggcgttgcgctcgatttcggtcatgatggtgtcacagctgttctcatggaaaatctggacgccgcgcacaggaggaacttggccaaagtcaccaatctccagaaccggaattcggtgcgacaacaggcgctcttcatcccactcgccgatcatggacgactcgtcgagaactaccaacttcggtttctcgtcgagcgagtctttgttggcaaacatgatttcgccgtcttcatcttcaccaatcggccgatagatgaagctgtggagggtccgggcattggtgcaacccttctcgcgaagccgcgctgctgctttcccggttggcgcgacgaagactgtccagtccatcgagcagcaaagttcggcgattatcttcgcgatggaagtcttaccagttccggcaaaaccggcgagtcgatagacctggcggcggtgcgctcgatcacaccaaccgcgataccagttaacgacggaattaatcgcgtcgatctgctggctattaggtcggaagccgaatcgctcttcgatctgatcgacggtgaagttagatgctgacatatttgcgttctccaacgctaggtttaattgaattgagactcagtttaagcagaccgtccacagaccacccagtatcacgacgatatttgcggccgtgcggatcgacatagaagtttttcgtgcgccgcaacaggacatagtgccaagcagcgccgagtgcatgaacccttcctttataagggaaggccttaagttgctctgcggccttcttcgccccagggagccagcggacggtcgaaaggaccaagaccgcacccttgacagcctgggaagcggcgcggccgtcctgtgggctatagcgatgtctatcggggtctacccagtggtggttgtcgcgccggagcttcaccgtccgggaccggccctcaaacaccacagtaccttcgtgagtaaaaatatgttccgccatggaatgttccttataacgtacagttctgctttacctctgcgcaagaagagtatactatcagctgactcgtcaaagcgagctaatttaatccgactttacttcggcaggaaagtggccgatactagcgccgccgcctgtactgccctccaaaacagaggatacattaaatgcaagaatgcaagatttcccgcgaccaactcccggtcggcaatccgaatcccaatgtcgacaagactcgcgacccgaacctaaagcccggctacctgcgtcgcagtcgcgagctggacccggctctggccgttcgcatccgtcgcgagctgatccatgcggaagcctccgacttggccatggccgggtgggtcaattcccagtccagcctctatggatcgaaagcgttcccgcgccattccgtcgttcgcgtgactgggatggcggaatctgaaacgaacatcggaatgctcatcggcttcatcgagcaccgcaagcacggtgaatgggcagttctggaaactgggacgaaagaaggcggcgcgatcaccatcccagtcgagagcatcatgcgtgcgtcattcgcagaggccgaagaattcgccgagaaatggaagcgtaacctggggtggcgcctcctgcgtcagcttcgtgaatgcggcgccctggccgggactgaagacgagttcctgcggcggatcatcaatcgatacgttcgtgatcgcacgatcctcgatcaccacaaagtcggcgcggacaaaacctatactgatgcagtactcaaaagcatcggcgaaacatggccgaagattccttcggggaaattcgtcggacaccgagtcgcgcagctcctgatcggccacaagctaggtcgagcggggaccatcctgaatgacctggtggacttcctggagaagttcgcggccgggcgcgataaagttctcaacatcgccatctgtaattgaggtgaatggcatgtataataaaccgactttgaatcaccaccatcaaaccgcattgttatatctgtataacaatcccgatcagccggccttcacaggccccaacaatcaggcgctaaatgaacttcggcagatggggtatgtaaaggcgaaaaaattcgaaaactgggcaggcaccggccatcttaggatggaatggacgctcaccaaggccgggattgagcgcgtcgaagtcgggtttctggggaagtgcgccgcttgcaagggaatcggtcagacgttgcttcgggggaagtgtactgtttgcaatggccgcggccaggggcggatcagcgaatggtcgcagaagccaatcgaagataatcctcaaattgcccctaagttcgaaaagaccgatgcgaataggcttgcagacgccattgaagaaatcggccggctggaaaaggcactggccgaatccgaaaagcgcgggagcgagctggccgcgagctattgtgacggcgtagtcggcgatgaatacggccatccttattgtcgttataaagtggaacgcgacgccgccttggccagggtcgcggagctggaagggaagttgacggactgggtgcacgaagggttccggctcaacgaggcgctagcggtcgccaaggctcaacccagcgtgccggaaatatctggcatcggtcgcgatgccgaacatcccagagctgtagtgctgtatctgcgtaacgaacccagcgatgaagatatgcgagcaattcagaactttttgcgcgccatggccgcccccgctcagcacagcgtgccgaaagcatggctcgacgttcaggcagagcgccgccggcaggtcgaggcccaggcgctaaggcaggaagtcgcagcactgcgcgcaagggcggatgttgtgccggaggtgttcgggcttgagcggtaccgcgtagaaaaaactgggaagggtttctggccatactgcgtgcgtgcgggggatggaacgcgtgaactgttcgtcggccacttgaagcagtgtcagcgggtagcgaccgaattggctacggcgtttgaagatgggaagtttatcgccgcgcccggcagctcggctcagcacagcgtgccggaggggtggaagctcgtaccgatggacccgacatcgcagatgacctatgtcggtcagtccctgcgttatgacgcggtaaacagcatcggcgagatttaccggcaaatgctcgccgtagctccctcacccatcgatccggccgcgcatcctcagccgtgccagcaaccacaggcccatcctgcccgctgcgggtgcgagcggtaagtgccaagtaaggaattcatgtaatggaacagaagaaaccttcaccagtagatggagtcataatgaccagcctcgacgttctccggaaagcacagcccgaagcccaggacgagtatgccgtgtccatgttcgcaacggcgatccgccagaaaatgcagcgctcccgcgataaaggccgaggcggctggatcgactgcgacgaagatattctgatcaacggattcgccgaacatgcgctgaagggaaatgagaacaacctcttggacctggcgacgttcctgatgttcatgtgggtgcgcggcatcgatgatgcgaagattcccccggcgctcgaaaaggcgcggcagcacaagatcatggaagcatggagtcgggcccacgaagatggactaaactccgccagaaaggcgagtgctgcgcgacagttcgtggaagtgcctcgacgcaaggggcgcccggagcgacttgcatgaagcctcacgaaataagactggcacaggccgaagagttcctgcgcgaactcggccgagggattccggacgacgaacgggtgatggtcggctacgcggaagaggccacagtccagaccgatgagaacggtcgcaagctcaacgccggctggtggcccgtgccctggaaggaaggcaagtacatcaattccaggtcaaacgcctacgcctgtatctcgtcttccatcaagacgcccaacccgaagaccggccagatgcgatactggcgcggcgaggcctctttcggccacggcctggcgttaatggtcgatgacatcggctccggcaaaggttccaaaggcgacttcgaccgcgacgagttccgcgaacgcctggagccgaccgcgattgtggagacttcgccgaacaactaccagttctggtatttcttcaaagagccgatggcccacatgctccagttcaaggcgctgctctattcgttcgtggaccaggtgctaaagaaaggcggtgacaacaccgtcaaagatgtcagccgttatggtcgcatgccattcggcttcaacaacaagcgcgggaaagacggcaagttcaaatatgccgacgaaaacggcaaacccgaactcgtgcgcctgtacagcgccgactattccaagcgctactcgccagaagagatcgcccaggcattcggcgtccgcatcatcatgccacagatgaagaaggtggagataaatcgcgacgattgggtttatgaccaagtatggctgaagtatgccgagcatatctgtacgaagtacaagatgggtgaggcagcgggcggccaagtccaacagaatatgtccggcaaatatcgcatccgctgcccatggggagacgagcatacaaatggcgatccattcggcgcctactttcgcgggccgatccctggagctgagcacgaatatgtattcggctgcggccacgatacttgccgcaaagagcatcgtcggacgtgggctgccttcacggatgaagtcgtgctaccctatatcgtcgaacaattggaaagaatcaaccgccgtcacatcggtgaggagtagacaatatgcaaaacgatcctggaattctgatcacagccattggcttgctgttcctcggccttatcatcttcttcgaaggcctaaagggatggaaaatacaagtcgcaaacttcctcgcgtcgcttctgtgcttcttcttcggcctttctgctttgacgttctggttcgtcgttgcgtttgacgtattttaatcgacgaacggtacagaaattttcggatggggacggaacttattagctatgccggtttaggtaggagataatagccgtccctttcgcctcaatatgtagaggcaatgttgaatccgatcatgtaaagcagaaggcggcaaacctaacatgattatcgacgaagataatatttttgatgatggcgaatcagggtccagtgagtttgatctcacgcagatagaagatgctggaatggaccctttgatgaccgccgcgagcaaggcggccgatgatgcgattgcgaggaacgaaacgcaccgcgcacaaaaggcggcaagatacgccgaggcgtatgcggaaccagacttgagaaagcgagcgcgattgttgatgctcgaccaggcgttcgatcttccggtcagccgggtggtgaaaggtccgttcgatgacttcatcactaaatacagctcaacttccgacagcaactatctcgcggtgtacgacactttgttctgcaagggcgatggaaccgtcccgcatccgcacttcgatgagtttcgcggccggctggtggaccatcgcggcgtggcgttcaacaacaagaccctcgatccgattgacctgatgggcgccctcgcggctgcggccttggacgatccctcgattaagaagacgattgagacttgctgcgtgtgggcgcgtcgatatcgccgcaactctttgatcgaaacgtttgagaagaagataccggagtgggacggcgaagagcgaattagcaagttgctgatcgatcttttcaagccgttcgacaccgaattgaaccggatggtaagcaggtatttctggctgagcctgtactgccgcatcaactatcctggaatctcggcgccgatctcgctggcgttgattggtgggcaggatgcggggaagacttacttttcaatcttgatctgtaaagagttgtcgagcgaccgaaagttatcgccggtccagcttgacctgagccgtcatgaccagacgccatttttgcgcaatatcactggcaactcggtgatcgcgaacgtcggcgaaatgtccggcttcaaaaagggcgacatggaacgcattaaagagttcctggtgcgatccgatgatactttcgatcagaagtttgaaccaggcgaaactatcagtcgacaatggatcaccatcatggacggcaacggctatgatggtcttcaacgggatgagtcaggaaaccgtcgattttatccaatgttcgtggcgcaacttcccgacgaggatggcaagccgaattgggttaaaccgggcgatggaaatgaaactttccgcgttgacttcaccgacttcggccgcaaattctggcaagccatggctgagtgccgcgcctggattaaggcgaatggcgtggagggatatctcgatctagttcgggcgaccaacaacgaagtccagaaattctctatttcggaaatggagaatgcgcgtggcgtggttcgtgatgacacgattgatatgtatctgatcaacgtgctgatcagttgcgaattcgaagagatcaagcctggcaggaattcaaagaatcctggatggagagtcaacaccatcgaaatcctgaaatggttcgatattctcgccaggaagaagccgatttctcgccacttaactccgcacctgaaggcgctaggatttgttccgaataagaatggcttgaatggatggtgcctgcctgtagataaggttgcacctggatggaccagagatatgcgcacgacgttgccgccgttcaatgatctgcttgtatacttgctgaggaaggtggattctgaggtgactgatgaagaggcaatgattcaaatccgcaaagttaaggccgagcgcgcaaggatattgggcgaggatttctgatgtagtgatggagtgtacttggactaggccgccttcgggcggtcttttctttggtgcggcgtacattcgattccggtggtggccgagtgagattcgaaagctatccggtaattagggtggggtggcgacggtgtattgtggaaagttcgtgaacgttggatcaaggattttgtgcggtgattggatgaattgtggaaaatcgacgattctgactggatttttggggtcggccgcgccggtcttactggtaattaccgaaaccaggaattagggtctagccttagtgccgcgtgggtttgaagggctttaccggatac

The invention claimed is:

1. A method of treating a bacterial infection comprising administering a composition comprising a bacteriophage comprising a polynucleotide sequence with at least 94% identity to SEQ ID NO: 6.

2. The method of claim 1, wherein the composition further comprises at least one additional bacteriophage.

3. The method of claim 1, the composition comprising two or more bacteriophages, wherein the composition further comprises at least one bacteriophage comprising a polynucleotide sequence with at least 97% identity to SEQ ID NO: 1, a polynucleotide sequence with at least 95% identity to SEQ ID NO: 3, or a polynucleotide sequence with at least 94% identity to SEQ ID NO: 4.

4. The method of claim 1, the composition comprising three or more bacteriophages, wherein the composition further comprises at least two bacteriophages comprising a polynucleotide sequence with at least 97% identity to SEQ ID NO: 1, a polynucleotide sequence with at least 95% identity to SEQ ID NO: 3, or a polynucleotide sequence with at least 94% identity to SEQ ID NO: 4.

5. The method of claim 1, the composition further comprising a bacteriophage comprising a polynucleotide sequence with at least 97% identity to SEQ ID NO: 1, a bacteriophage comprising a polynucleotide sequence with at least 95% identity to SEQ ID NO: 3, and a bacteriophage comprising a polynucleotide sequence with at least 94% identity to SEQ ID NO: 4.

6. The method of claim 1, wherein the bacteriophage comprises a polynucleotide sequence with at least 95% sequence identity to SEQ ID NO:6.

7. The method of claim 6 wherein the bacteriophage comprises a polynucleotide sequence with at least 96% sequence identity SEQ ID NO:6.

8. The method of claim 7, wherein the bacteriophage comprises a polynucleotide sequence with at least 97% sequence identity to SEQ ID NO:6.

9. The method of claim 7, wherein the bacteriophage comprises a polynucleotide sequence with at least 98% sequence identity to SEQ ID NO:6.

10. A method of treating a bacterial infection comprising administering a composition comprising two or more bacteriophages comprising a first bacteriophage comprising a polynucleotide sequence with at least 94% identity to SEQ ID NO: 6, and one or more additional bacteriophages comprising a polynucleotide sequence with at least 90% identity to SEQ ID NO: 1, a polynucleotide sequence with at least 90% identity to SEQ ID NO: 3, a polynucleotide sequence with at least 90% identity to SEQ ID NO: 4, or a polynucleotide sequence with at least 90% identity to SEQ ID NO: 18.

11. The method of claim 10, comprising administering a composition comprising two or more bacteriophages comprising a first bacteriophage comprising a polynucleotide sequence with at least 94% identity to SEQ ID NO: 6, and one or more additional bacteriophages comprising a polynucleotide sequence with at least 99% identity to SEQ ID NO: 1, a polynucleotide sequence with at least 98% identity to SEQ ID NO: 3, a polynucleotide sequence with at least 90% identity to SEQ ID NO: 4, or a polynucleotide sequence with at least 95% identity to SEQ ID NO: 20.

12. The method of claim 1, wherein the composition comprises one or more additional bacteriophage comprising a polynucleotide sequence having at least 90% identity to a polynucleotide sequence selected from: SEQ ID NO: 2, SEQ ID NO: 5, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, and/or SEQ ID NO: 22.

13. The method of claim 1, wherein the composition's target bacteria range is broader than the cumulative range of the individual bacteriophage in the composition, and wherein the target bacteria range is broadened within the bacterial species that the bacteriophage is able to infect.

14. The method of claim 12, wherein the one or more additional bacteriophage comprises a polynucleotide sequence with at least a 90% identity to SEQ ID NO: 7, a polynucleotide with at least a 93% identity to SEQ ID NO: 8, a polynucleotide sequence with at least 93% identity to SEQ ID NO: 9, a polynucleotide sequence with at least 89% identity to SEQ ID NO: 10, a polynucleotide sequence with at least 95% identity to SEQ ID NO: 11, a polynucleotide sequence with at least 91% identity to SEQ ID NO: 12, a polynucleotide sequence with at least 92% identity to SEQ ID NO: 13, a polynucleotide sequence with at least 96% identity to SEQ ID NO: 14 a polynucleotide sequence with at least 95% identity to SEQ ID NO: 15, a polynucleotide sequence with at least 90% identity to SEQ ID NO: 16, a polynucleotide sequence with at least 92% identity to SEQ ID NO: 17, a polynucleotide sequence with at least 95% identity to SEQ ID NO: 18, a polynucleotide sequence with at least 96% identity to SEQ ID NO: 19, a polynucleotide sequence with at least 96% identity to SEQ ID NO: 20, a polynucleotide sequence with at least 96% identity to SEQ ID NO: 21, or a polynucleotide sequence with at least 95% identity to SEQ ID NO: 22.

15. The method of claim 1, wherein the bacteriophage is resistant to sputum inactivation.

16. The method of claim 1, wherein the bacterial infection comprises a pulmonary infection, and/or rhinosinusitis.

17. The method of claim 1, wherein the bacterial infection in in the presence of cystic fibrosis, non-cystic fibrosis bronchiectasis (NCFB), a lung fibrosis condition and/or pneumonia.

18. The method of claim 3, wherein the composition further comprises a bacteriophage comprising a polynucleotide sequence with at least 97% identity to SEQ ID NO: 1.

19. The method of claim 3, wherein the composition further comprises a bacteriophage comprising a polynucleotide sequence with at least 95% identity to SEQ ID NO: 3.

20. The method of claim 3, wherein the composition further comprises a bacteriophage comprising a polynucleotide sequence with at least 94% identity to SEQ ID NO: 4.

21. The method of claim 1, wherein the bacteriophage comprises a polynucleotide sequence with at least 99% sequence identity to SEQ ID NO:6.

* * * * *